(12) United States Patent
Lotta et al.

(10) Patent No.: US 11,759,476 B2
(45) Date of Patent: *Sep. 19, 2023

(54) METHODS OF TREATING METABOLIC DISORDERS AND CARDIOVASCULAR DISEASE WITH INHIBIN SUBUNIT BETA E (INHBE) INHIBITORS

(71) Applicant: Regeneron Pharmaceuticals, Inc., Tarrytown, NY (US)

(72) Inventors: Luca Andrea Lotta, Tarrytown, NY (US); Parsa Akbari, Tarrytown, NY (US); Olukayode Sosina, Tarrytown, NY (US); Manuel Allen Revez Ferreira, Tarrytown, NY (US); Aris Baras, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/711,137

(22) Filed: Apr. 1, 2022

(65) Prior Publication Data

US 2022/0313726 A1 Oct. 6, 2022

Related U.S. Application Data

(63) Continuation of application No. 17/549,692, filed on Dec. 13, 2021.

(60) Provisional application No. 63/274,595, filed on Nov. 2, 2021, provisional application No. 63/233,258, filed on Aug. 14, 2021, provisional application No. 63/159,019, filed on Mar. 10, 2021, provisional application No. 63/124,949, filed on Dec. 14, 2020.

(51) Int. Cl.
| | |
|---|---|
| *A61K 31/7105* | (2006.01) |
| *A61P 9/10* | (2006.01) |
| *A61P 1/16* | (2006.01) |
| *A61P 3/04* | (2006.01) |
| *A61P 3/10* | (2006.01) |
| *A61K 38/46* | (2006.01) |
| *A61K 31/7088* | (2006.01) |
| *A61K 31/713* | (2006.01) |

(52) U.S. Cl.
CPC ...... *A61K 31/7105* (2013.01); *A61K 31/7088* (2013.01); *A61K 31/713* (2013.01); *A61K 38/465* (2013.01); *A61P 1/16* (2018.01); *A61P 3/04* (2018.01); *A61P 3/10* (2018.01); *A61P 9/10* (2018.01)

(58) Field of Classification Search
CPC .. A61K 31/713; A61K 45/06; A61K 2300/00; A61P 1/16; A61P 3/04; A61P 3/00; C12Q 1/6883; C12Q 2600/156
USPC .............. 435/6.1, 91.1, 91.31, 455, 458; 514/44 A, 44 R; 536/23.1, 24.5
See application file for complete search history.

(56) References Cited

U.S. PATENT DOCUMENTS

| | | |
|---|---|---|
| 7,507,787 B2 | 3/2009 | Hancock et al. |
| 7,687,454 B2 | 3/2010 | Hancock et al. |
| 8,137,970 B2 | 3/2012 | Jhon et al. |
| 8,236,527 B2 | 8/2012 | Chen et al. |
| 8,269,061 B2 | 9/2012 | Williams |
| 9,121,032 B2 | 9/2015 | Williams et al. |
| 9,526,800 B2 | 12/2016 | Hynes et al. |
| 9,651,565 B2 | 5/2017 | Wetzel et al. |
| 9,994,903 B2 | 6/2018 | Chan et al. |
| 10,024,860 B2 | 7/2018 | Hynes et al. |
| 10,619,211 B2 | 4/2020 | Kelsey et al. |
| 10,620,224 B2 | 4/2020 | Wetzel et al. |
| 11,078,247 B2 | 8/2021 | Fotin-Mleczek et al. |
| 11,191,775 B2 | 12/2021 | Han et al. |
| 2007/0134261 A1 | 6/2007 | Hancock et al. |
| 2007/0190533 A1 | 8/2007 | Hancock et al. |
| 2008/0189801 A1 | 8/2008 | Williams et al. |
| 2010/0111983 A1 | 5/2010 | Sen |
| 2010/0144838 A1 | 6/2010 | Beck et al. |
| 2010/0291580 A1 | 11/2010 | Parimoo et al. |
| 2012/0141603 A1 | 6/2012 | Tsao et al. |
| 2012/0258878 A1 | 10/2012 | Saad |
| 2013/0095062 A1 | 4/2013 | Chen et al. |
| 2013/0202564 A1 | 8/2013 | Han et al. |
| 2014/0178348 A1 | 6/2014 | Kelsey et al. |
| 2014/0287948 A1 | 9/2014 | Boniface et al. |
| 2014/0287950 A1 | 9/2014 | Hickok et al. |
| 2015/0099295 A1 | 4/2015 | Chen et al. |
| 2015/0284455 A1 | 10/2015 | Springer et al. |
| 2016/0154003 A1 | 6/2016 | Boniface et al. |

(Continued)

FOREIGN PATENT DOCUMENTS

| | | |
|---|---|---|
| EP | 3260130 | 12/2017 |
| WO | 2003048383 | 6/2003 |

(Continued)

OTHER PUBLICATIONS

Sugiyama et al (PLOS ONE, pp. 1-20 (Mar. 29, 2018)) (Year: 2018).*

(Continued)

*Primary Examiner* — Jane J Zara
(74) *Attorney, Agent, or Firm* — Armstrong Teasdale LLP

(57) ABSTRACT

The present disclosure provides methods of treating a subject having metabolic disorders and/or cardiovascular diseases, methods of identifying subjects having an increased risk of developing a metabolic disorder and/or a cardiovascular disease, and methods of detecting human Inhibin Subunit Beta E variant nucleic acid molecules and variant polypeptides.

16 Claims, 10 Drawing Sheets

Specification includes a Sequence Listing.

(56) References Cited

U.S. PATENT DOCUMENTS

| | | |
|---|---|---|
| 2017/0051073 A1 | 2/2017 | Hynes et al. |
| 2017/0146548 A1 | 5/2017 | Hickok et al. |
| 2017/0182080 A1 | 6/2017 | Han |
| 2017/0306027 A1 | 10/2017 | Knopf et al. |
| 2018/0172696 A1 | 6/2018 | Boniface et al. |
| 2018/0291455 A1 | 10/2018 | Chan et al. |
| 2019/0216846 A1 | 7/2019 | Javanbakht et al. |
| 2019/0317107 A1 | 10/2019 | Boniface et al. |
| 2019/0376978 A1 | 12/2019 | Hickok et al. |
| 2020/0024339 A1 | 1/2020 | Springer et al. |
| 2020/0138976 A1 | 5/2020 | Murphy et al. |
| 2020/0147118 A1 | 5/2020 | Rayner et al. |
| 2020/0297752 A1 | 9/2020 | Gong et al. |
| 2020/0347359 A1 | 11/2020 | Magin et al. |
| 2020/0392454 A1 | 12/2020 | Chai et al. |
| 2021/0002296 A1 | 1/2021 | Mainolfi et al. |
| 2022/0002364 A1 | 1/2022 | Selvaraj et al. |
| 2022/0025369 A1 | 1/2022 | Fotin-Mleczek et al. |

FOREIGN PATENT DOCUMENTS

| | | |
|---|---|---|
| WO | 2011053281 | 5/2011 |
| WO | 2012022634 | 2/2012 |
| WO | 2012162660 | 11/2012 |
| WO | 2014089121 | 6/2014 |
| WO | 2017075037 | 5/2017 |
| WO | 2021092474 | 5/2021 |
| WO | 2021216460 | 10/2021 |

OTHER PUBLICATIONS

Hashimoto et al (Cell Reports, vol. 25, pp. 1193-1203 (2018)) (Year: 2018).*

U.S. Appl. No. 17/549,692 (Year: 2021).*

Sugiyama et al., "Inhibin [beta]E (INHBE) is a possible insulin resistance-associated hepatokine identified by comprehensive gene expression analysis in human liver biopsy samples", PLoS ONE, 2018, 13(3), pp. e0194798.

Hashimoto et al., "Activin E Controls Energy Homeostasis in Both Brown and White Adipose Tissue as a Hepatokine", Cell Reports, 2018, 25(5), pp. 1193-1203.

International Search Report and Written Opinion dated Jun. 2, 2022 for International Patent Application No. PCT/US2021/063150.

Non-Final Office Action dated Apr. 3, 2023 in U.S. Appl. No. 17/823,586.

Damase et al., "The Limitless Future of RNA Therapeutics", Frontiers in Bioengineering and Biotechnology, 2021, 9, pp. 1-24.

Roberts et al., "Advances in oligonucleotide drug delivery", Nature Reviews Drug Discovery, 2020, 19, pp. 673-694.

Non-Final Office Action dated Apr. 5, 2023 in U.S. Appl. No. 17/549,692.

Mayo Clinic, "Metformin (Oral Route)—Type 2 diabetes diagnosis and treatment", 2015, pp. 1-8.

* cited by examiner

12:57456093:G:C (splice acceptor SNP, c.299-1G>C )

ORIGINAL EXON 2
AGACTCCACTTCAGCCTACAGCT

PREDICTED EXON 2
ACACTCCACTTCAGCCTACAGCT

Exon 2 Shortened by 12 bp from the 5' end of exon which will lead to an inframe deletion of 4 amino acids

Figure 3

INHBE Reference Sequence

MRLPDVQLWLVLLWALVRAQGTGSVCPSCGGSKLAPQAERALVLELAKQQILDGLHLTSR
PRITHPPQAALTRALRRLQPGSVAPGNGEEVISFATVTDSTSAYSSLLTFHLSTPRSHH
LYHARLWLHVLPTLPGTLCLRIFRWGPRRRQGSRTLLAEHHITNLGWHTLTLPSSGLRG
EKSGVLKLQLDCRPLEGNSTVTGQPRRLLDTAGHQQPFLELKIRANEPGAGRARRRTPTC
EPATPLCCRRDHYVDFQELGWRDWILQPEGYQLNYCSGQCPPHLAGSPGIAASFHSAVFS
LLKANNPWPASTSCCVPTARRPLSLLYLDHNGNVVKTDVPDMVEACGCS

INHBE Predicted Sequence (splice acceptor variant)

MRLPDVQLWLVLLWALVRAQGTGSVCPSCGGSKLAPQAERALVLELAKQQILDGLHLTSR
PRITHPPQAALTRALRRLQPGSVAPGNGEEVISFATVTDSTSAYSSLLTFHLSTPRSHH
LYHARLWLHVLPTLPGTLCLRIFRWGPRRRQGSRTLLAEHHITNLGWHTLTLPSSGLRG
EKSGVLKLQLDCRPLEGNSTVTGQPRRLLDTAGHQQPFLELKIRANEPGAGRARRRTPTC
EPATPLCCRRDHYVDFQELGWRDWILQPEGYQLNYCSGQCPPHLAGSPGIAASFHSAVFS
LLKANNPWPASTSCCVPTARRPLSLLYLDHNGNVVKTDVPDMVEACGCS

Figure 4

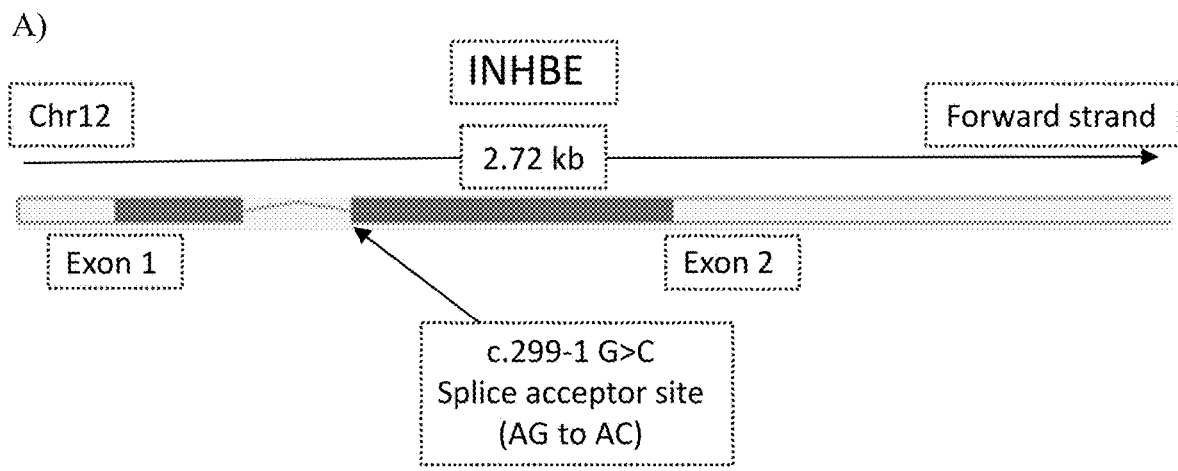
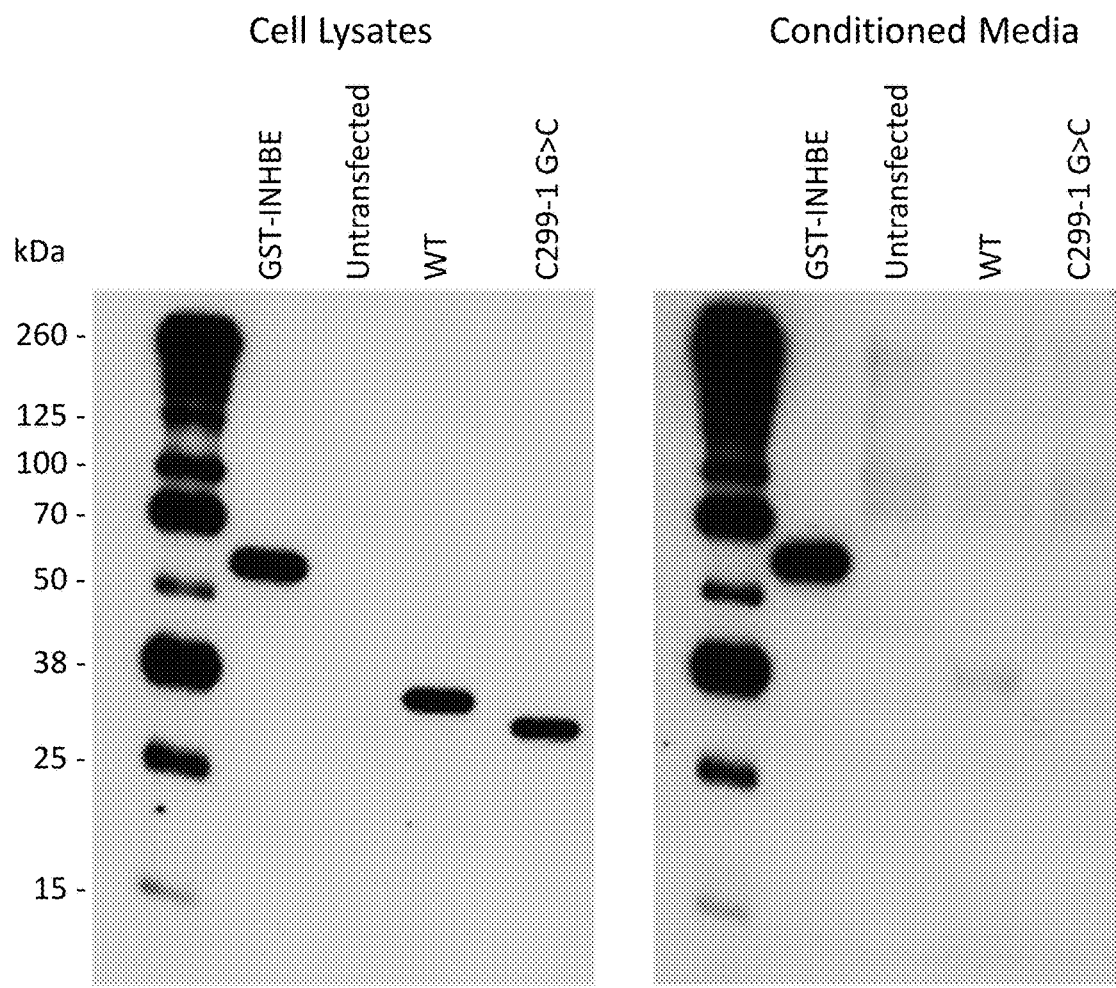
Figure 5

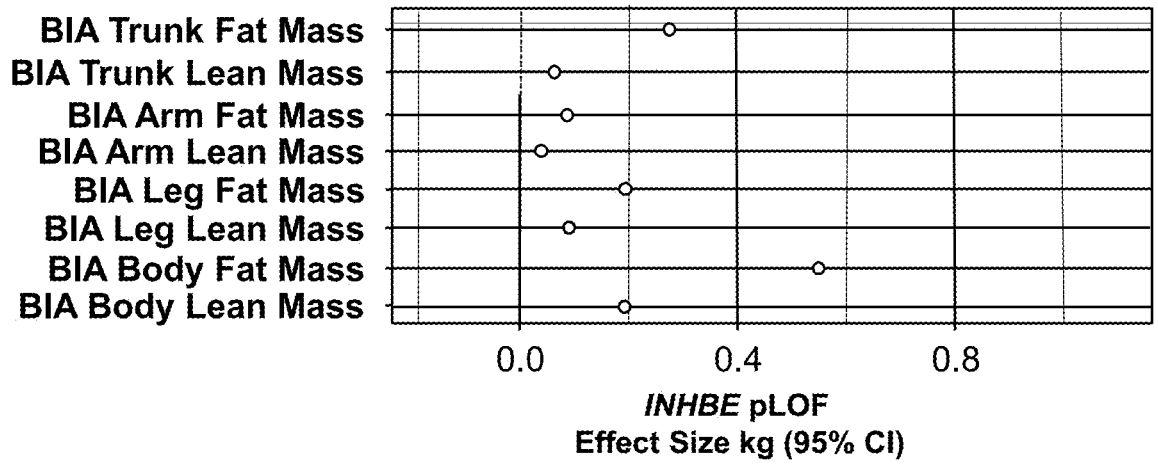
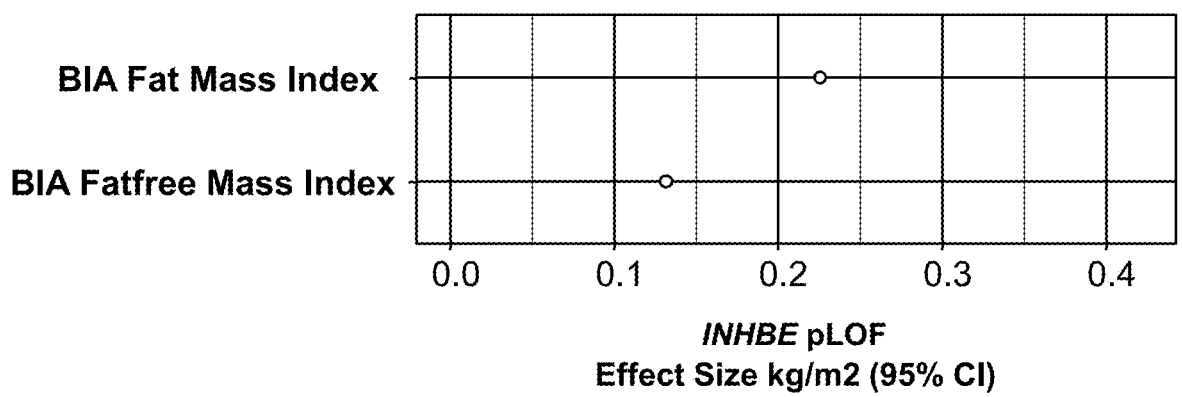
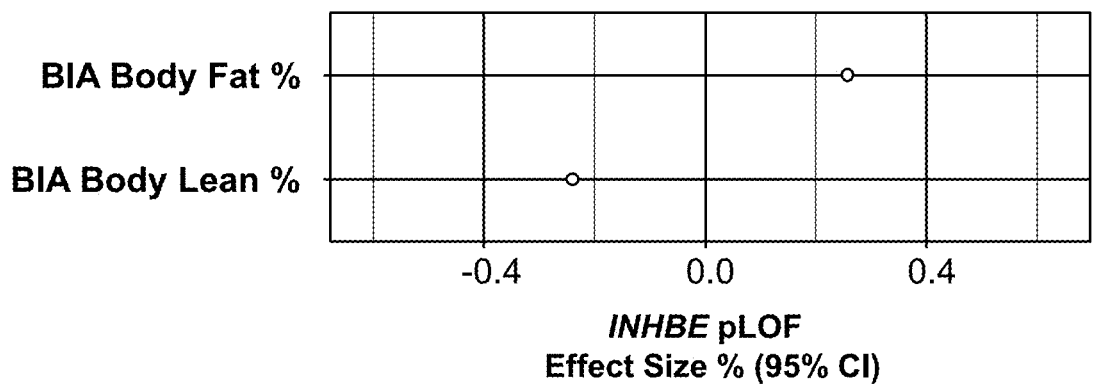
Figure 6

| Comparison | Fold-difference | P-value |
|---|---|---|
| Simple steatosis vs healthy liver | 1.25 | $4.1 \times 10^{-16}$ |
| NASH vs healthy liver | 1.60 | $2.0 \times 10^{-63}$ |
| NASH vs simple steatosis | 1.28 | $5.4 \times 10^{-23}$ |

Figure 8 (cont.)

METHODS OF TREATING METABOLIC DISORDERS AND CARDIOVASCULAR DISEASE WITH INHIBIN SUBUNIT BETA E (INHBE) INHIBITORS

REFERENCE TO SEQUENCE LISTING

This application includes a Sequence Listing submitted electronically as a text file named 18923805711SEQ, created on Apr. 1, 2022, with a size of 974 kilobytes. The Sequence Listing is incorporated herein by reference.

FIELD

The present disclosure relates generally to the treatment of subjects having metabolic disorders and/or cardiovascular disease with Inhibin Subunit Beta E inhibitors, methods of identifying subjects having an increased risk of developing a metabolic disorder and/or cardiovascular disease, and methods of detecting INHBE variant nucleic acid molecules and variant polypeptides.

BACKGROUND

Body fat distribution is an important risk factor for cardiovascular and metabolic disease independent of overall adiposity. A body fat distribution characterized by higher accumulation of fat around the waist (such as greater abdominal fat or larger waist circumference) and/or lower accumulation of fat around the hips (such as lower gluteofemoral fat or smaller hip circumference), resulting in a greater waist-to-hip ratio (WHR), is associated with higher cardio-metabolic risk independent of body mass index (BMI). Metabolic conditions associated with body fat distribution include, but are not limited to: type 2 diabetes, hyperlipidemia or dyslipidemia (high or altered circulating levels of low-density lipoprotein cholesterol (LDL-C), triglycerides, very low-density lipoprotein cholesterol (VLDL-C), apolipoprotein B or other lipid fractions), obesity (particularly abdominal obesity), lipodystrophy (such as an inability to deposit fat in adipose depots regionally (partial lipodystrophy) or in the whole body (lipoatrophy)), insulin resistance or higher or altered insulin levels at fasting or during a metabolic challenge, liver fat deposition or fatty liver disease and their complications (such as, for example, cirrhosis, fibrosis, or inflammation of the liver), nonalcoholic steatohepatitis, other types of liver inflammation, higher or elevated or altered liver enzyme levels or other markers of liver damage, inflammation or fat deposition in the liver, higher blood pressure and/or hypertension, higher blood sugar or glucose or hyperglycemia, metabolic syndrome, coronary artery disease, and other atherosclerotic conditions, and the complications of each of the aforementioned conditions. Identifying genetic variants associated with a more favorable fat distribution (such as a lower WHR, particularly when adjusted for BMI) can be a pathway to identify mechanisms that can be exploited therapeutically for benefit in these cardio-metabolic diseases.

Inhibin Subunit Beta E (INHBE) is a member of the TGF-beta (transforming growth factor-beta) superfamily of proteins. Inhibins have been implicated in regulating numerous cellular processes including cell proliferation, apoptosis, immune response and hormone secretion. Inhibins and activins inhibit and activate, respectively, the secretion of follitropin by the pituitary gland. Inhibins/activins are involved in regulating a number of diverse functions such as hypothalamic and pituitary hormone secretion, gonadal hormone secretion, germ cell development and maturation, erythroid differentiation, insulin secretion, nerve cell survival, embryonic axial development or bone growth, depending on their subunit composition. Inhibins appear to oppose the functions of activins. In addition, INHBE may be upregulated under conditions of endoplasmic reticulum stress, and this protein may inhibit cellular proliferation and growth in pancreas and liver.

SUMMARY

The present disclosure provides methods of treating a subject having a metabolic disorder or at risk of developing a metabolic disorder, the methods comprising administering an INHBE inhibitor to the subject.

The present disclosure also provides methods of treating a subject having type 2 diabetes or at risk of developing type 2 diabetes, the methods comprising administering an INHBE inhibitor to the subject.

The present disclosure also provides methods of treating a subject having obesity or at risk of developing obesity, the methods comprising administering an INHBE inhibitor to the subject.

The present disclosure also provides methods of treating a subject having elevated triglyceride level (hypertriglyceridemia) or at risk of developing elevated triglyceride level (hypertriglyceridemia), the methods comprising administering an INHBE inhibitor to the subject.

The present disclosure also provides methods of treating a subject having lipodystrophy or at risk of developing lipodystrophy, the methods comprising administering an INHBE inhibitor to the subject.

The present disclosure also provides methods of treating a subject having liver inflammation or at risk of developing liver inflammation, the methods comprising administering an INHBE inhibitor to the subject.

The present disclosure also provides methods of treating a subject having fatty liver disease or at risk of developing fatty liver disease, the methods comprising administering an INHBE inhibitor to the subject.

The present disclosure also provides methods of treating a subject having hypercholesterolemia or at risk of developing hypercholesterolemia, the methods comprising administering an INHBE inhibitor to the subject.

The present disclosure also provides methods of treating a subject having elevated liver enzymes (such as, for example, alanine transaminase (ALT) and/or aspartate transaminase (AST)) or at risk of developing elevated liver enzymes (such as, for example, ALT and/or AST), the methods comprising administering an INHBE inhibitor to the subject.

The present disclosure also provides methods of treating a subject having nonalcoholic steatohepatitis (NASH) or at risk of developing NASH, the methods comprising administering an INHBE inhibitor to the subject.

The present disclosure also provides methods of treating a subject having a cardiovascular disease or at risk of developing a cardiovascular disease, the methods comprising administering an INHBE inhibitor to the subject.

The present disclosure also provides methods of treating a subject having cardiomyopathy or at risk of developing cardiomyopathy, the methods comprising administering an INHBE inhibitor to the subject.

The present disclosure also provides methods of treating a subject having heart failure or at risk of developing heart failure, the methods comprising administering an INHBE inhibitor to the subject.

The present disclosure also provides methods of treating a subject having high blood pressure or at risk of developing high blood pressure, the methods comprising administering an INHBE inhibitor to the subject.

The present disclosure also provides methods of treating a subject with a therapeutic agent that treats or inhibits a metabolic disorder, wherein the subject is suffering from a metabolic disorder, the methods comprise the steps of: determining whether the subject has an INHBE variant nucleic acid molecule encoding an INHBE predicted loss-of-function polypeptide by: obtaining or having obtained a biological sample from the subject; and performing or having performed a genotyping assay on the biological sample to determine if the subject has a genotype comprising the INHBE variant nucleic acid molecule; and when the subject is INHBE reference, then administering or continuing to administer to the subject the therapeutic agent that treats or inhibits the metabolic disorder in a standard dosage amount, and administering to the subject an INHBE inhibitor; and when the subject is heterozygous for an INHBE variant nucleic acid molecule, then administering or continuing to administer to the subject the therapeutic agent that treats or inhibits the metabolic disorder in an amount that is the same as or lower than a standard dosage amount, and administering to the subject an INHBE inhibitor; when the subject is homozygous for an INHBE variant nucleic acid molecule, then administering or continuing to administer to the subject the therapeutic agent that treats or inhibits the metabolic disorder in an amount that is the same as or lower than a standard dosage amount; wherein the presence of a genotype having the INHBE variant nucleic acid molecule encoding the INHBE predicted loss-of-function polypeptide indicates the subject has a decreased risk of developing the metabolic disorder.

The present disclosure also provides methods of treating a subject with a therapeutic agent that treats or inhibits a cardiovascular disease, wherein the subject is suffering from a cardiovascular disease, the methods comprise the steps of: determining whether the subject has an INHBE variant nucleic acid molecule encoding an INHBE predicted loss-of-function polypeptide by: obtaining or having obtained a biological sample from the subject; and performing or having performed a genotyping assay on the biological sample to determine if the subject has a genotype comprising the INHBE variant nucleic acid molecule; and when the subject is INHBE reference, then administering or continuing to administer to the subject the therapeutic agent that treats or inhibits the cardiovascular disease in a standard dosage amount, and administering to the subject an INHBE inhibitor; and when the subject is heterozygous for an INHBE variant nucleic acid molecule, then administering or continuing to administer to the subject the therapeutic agent that treats or inhibits the cardiovascular disease in an amount that is the same as or lower than a standard dosage amount, and administering to the subject an INHBE inhibitor; when the subject is homozygous for an INHBE variant nucleic acid molecule, then administering or continuing to administer to the subject the therapeutic agent that treats or inhibits the cardiovascular disease in an amount that is the same as or lower than a standard dosage amount; wherein the presence of a genotype having the INHBE variant nucleic acid molecule encoding the INHBE predicted loss-of-function polypeptide indicates the subject has a decreased risk of developing the cardiovascular disease.

The present disclosure also provides methods of identifying a subject having an increased risk for developing a metabolic disorder, wherein the methods comprise: determining or having determined the presence or absence of an INHBE variant nucleic acid molecule encoding an INHBE predicted loss-of-function polypeptide in a biological sample obtained from the subject; wherein: when the subject is INHBE reference, then the subject has an increased risk for developing the metabolic disorder; and when the subject is heterozygous for an INHBE variant nucleic acid molecule or homozygous for an INHBE variant nucleic acid molecule, then the subject has a decreased risk for developing the metabolic disorder.

The present disclosure also provides methods of identifying a subject having an increased risk for developing a cardiovascular disease, wherein the methods comprise: determining or having determined the presence or absence of an INHBE variant nucleic acid molecule encoding an INHBE predicted loss-of-function polypeptide in a biological sample obtained from the subject; wherein: when the subject is INHBE reference, then the subject has an increased risk for developing the cardiovascular disease; and when the subject is heterozygous for an INHBE variant nucleic acid molecule or homozygous for an INHBE variant nucleic acid molecule, then the subject has a decreased risk for developing the cardiovascular disease.

The present disclosure also provides therapeutic agents that treat or inhibit a metabolic disorder for use in the treatment of the metabolic disorder in a subject having: an INHBE variant genomic nucleic acid molecule encoding an INHBE predicted loss-of-function polypeptide; an INHBE variant mRNA molecule encoding an INHBE predicted loss-of-function polypeptide; or an INHBE variant cDNA molecule encoding an INHBE predicted loss-of-function polypeptide.

The present disclosure also provides therapeutic agents that treat or inhibit a cardiovascular disease for use in the treatment of the cardiovascular disease in a subject having: an INHBE variant genomic nucleic acid molecule encoding an INHBE predicted loss-of-function polypeptide; an INHBE variant mRNA molecule encoding an INHBE predicted loss-of-function polypeptide; or an INHBE variant cDNA molecule encoding an INHBE predicted loss-of-function polypeptide.

The present disclosure also provides INHBE inhibitors that treat or inhibit a metabolic disorder for use in the treatment of the metabolic disorder in a subject having: an INHBE variant genomic nucleic acid molecule encoding an INHBE predicted loss-of-function polypeptide; an INHBE variant mRNA molecule encoding an INHBE predicted loss-of-function polypeptide; or an INHBE variant cDNA molecule encoding an INHBE predicted loss-of-function polypeptide.

The present disclosure also provides INHBE inhibitors that treat or inhibit a cardiovascular disease for use in the treatment of the cardiovascular disease in a subject having: an INHBE variant genomic nucleic acid molecule encoding an INHBE predicted loss-of-function polypeptide; an INHBE variant mRNA molecule encoding an INHBE predicted loss-of-function polypeptide; or an INHBE variant cDNA molecule encoding an INHBE predicted loss-of-function polypeptide.

BRIEF DESCRIPTION OF THE FIGURES

The accompanying figures, which are incorporated in and constitute a part of this specification, illustrate several aspects and together with the description serve to explain the principles of the present disclosure.

FIG. 3 shows the in silico predicted functional consequences of the INHBE c.299-1G:C (12:57456093:G:C) splice variant; top sequence=original exon 2 (SEQ ID NO:28); bottom sequence=predicted exon 2 (SEQ ID NO:29).

FIG. 4 shows the wild type INHBE protein sequence (top; SEQ ID NO:8) and the in silico predicted protein sequence for the c.299-1G:C acceptor splice variant (bottom; SEQ ID NO:8 with change in amino acids "STS" after underlined and bolded amino acid "D").

FIG. 5 shows Chinese hamster ovary (CHO) cells experiments for the c.299-1G>C: variant. The variant occurs in the splice acceptor site for the first and only splice junction in the INHBE gene (Panel A). In CHO cells, the c.299-1G>C variant results in the expression of a lower molecular weight variant which is present in cell lysates but not in the media, consistent with a loss-of-function (Panel B).

FIG. 6 shows associations of INHBE pLOF variants with body fat and lean mass, percentage and body-surface adjusted indices as measured by electrical bioimpedance in 423,418 participants from the UKB study.

DESCRIPTION

Figure 1:
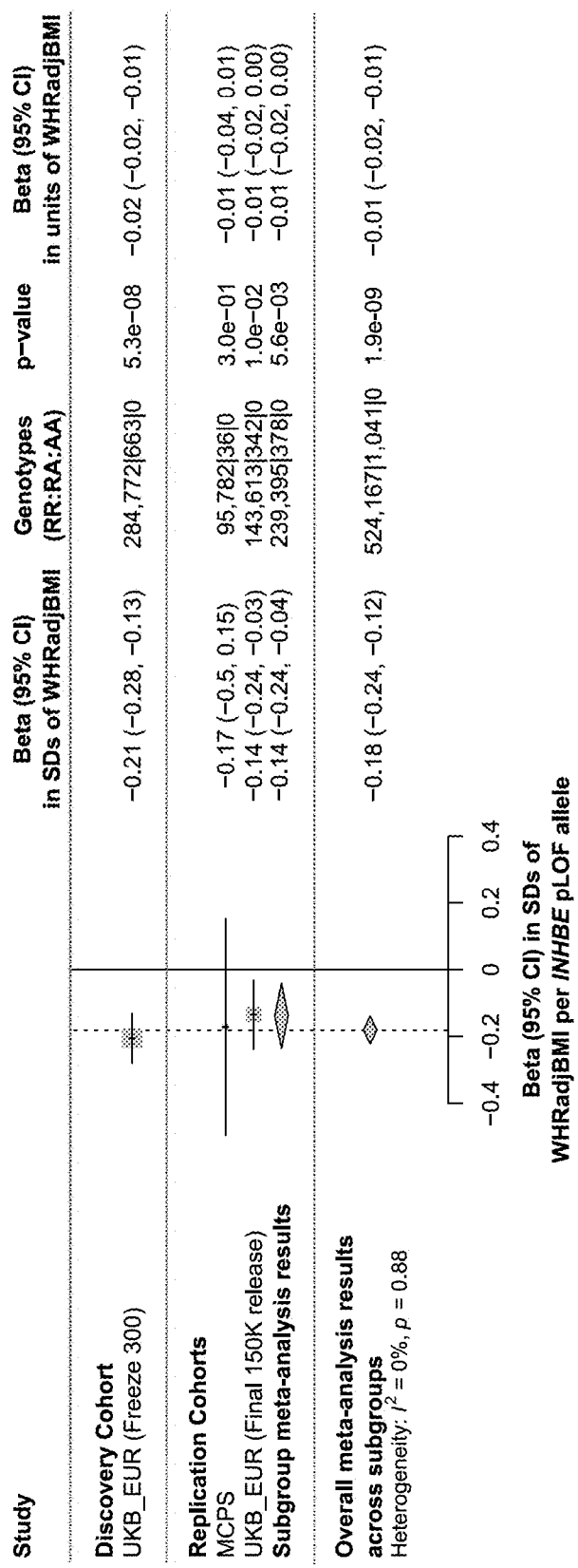
FIG. 1 shows association of INHBE predicted loss-of-function (pLOF) variants with a favorable fat distribution (i.e., lower BMI adjusted WHR) in an exome sequencing analysis of over 525,000 people from multiple studies; association analyses were estimated by fitting mixed-effects linear regression models accounting for relatedness and population stratification using the REGENIE software; abbreviations: confidence interval, CI; standard deviation, SD; body mass index, BMI; waist-hip ratio adjusted for BMI, WHRadjBMI; reference-reference allele, RR; reference-alternative allele, RA; alternative-alternative allele, AA; UK Biobank cohort, UKB; European ancestry, EUR; Mexico city prospective study cohort, MCPS; predicted loss-of-function, pLOF.

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the term "isolated", in regard to a nucleic acid molecule or a polypeptide, means that the nucleic acid molecule or polypeptide is in a condition other than its native environment, such as apart from blood and/or animal tissue. In some embodiments, an isolated nucleic acid molecule or polypeptide is substantially free of other nucleic acid molecules or other polypeptides, particularly other nucleic acid molecules or polypeptides of animal origin. In some embodiments, the nucleic acid molecule or polypeptide can be in a highly purified form, i.e., greater than 95% pure or greater than 99% pure. When used in this context, the term "isolated" does not exclude the presence of the same nucleic acid molecule or polypeptide in alternative physical forms, such as dimers or Alternately phosphorylated or derivatized forms.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates. In some embodiments, the subject is a human. In some embodiments, the human is a patient under the care of a physician.

It has been observed in accordance with the present disclosure that loss-of-function variants in INHBE (whether these variations are homozygous or heterozygous in a particular subject) associate with a decreased risk of developing a metabolic disorder, such as type 2 diabetes, obesity, lipodystrophy, liver inflammation, fatty liver disease, hypercholesterolemia, elevated liver enzymes (such as, for example, ALT and/or AST), NASH, and/or elevated triglyceride level, and/or a cardiovascular disease, such as cardiomyopathy, heart failure, and high blood pressure. It is believed that loss-of-function variants in the INHBE gene or protein have not been associated with metabolic disorders and/or cardiovascular disease in genome-wide or exome-wide association studies. Therefore, subjects that are homozygous or heterozygous for reference INHBE variant nucleic acid molecules may be treated with an INHBE inhibitor such that a metabolic disorder and/or cardiovascular disease is inhibited, the symptoms thereof are reduced, and/or development of symptoms is repressed. It is also believed that such subjects having metabolic disorders and/or cardiovascular disease may further be treated with therapeutic agents that treat or inhibit a metabolic disorder, such as type 2 diabetes, obesity, high blood pressure, lipodystrophy, liver inflammation, fatty liver disease, hypercholesterolemia, elevated liver enzymes (such as, for example, ALT and/or AST), NASH, and/or elevated triglyceride level, and/or cardiovascular disease such as cardiomyopathy, heart failure, and high blood pressure.

For purposes of the present disclosure, any particular subject, such as a human, can be categorized as having one of three INHBE genotypes: i) INHBE reference; ii) heterozygous for an INHBE variant nucleic acid molecule encoding an INHBE predicted loss-of-function polypeptide; or iii) homozygous for an INHBE variant nucleic acid molecule encoding an INHBE predicted loss-of-function polypeptide. A subject is INHBE reference when the subject does not have a copy of an INHBE variant nucleic acid molecule encoding an INHBE predicted loss-of-function polypeptide. A subject is heterozygous for an INHBE variant nucleic acid molecule when the subject has a single copy of an INHBE variant nucleic acid molecule encoding an INHBE predicted loss-of-function polypeptide. An INHBE variant nucleic acid molecule is any nucleic acid molecule (such as, a genomic nucleic acid molecule, an mRNA molecule, or a cDNA molecule) encoding an INHBE polypeptide having a partial loss-of-function, a complete loss-of-function, a predicted partial loss-of-function, or a predicted complete loss-of-function. A subject who has an INHBE polypeptide having a partial loss-of-function (or predicted partial loss-of-function) is hypomorphic for INHBE. A subject is homozygous for an INHBE variant nucleic acid molecule encoding an INHBE predicted loss-of-function polypeptide when the subject has two copies (same or different) of an INHBE variant nucleic acid molecule encoding an INHBE predicted loss-of-function polypeptide.

For subjects that are genotyped or determined to be INHBE reference, such subjects have an increased risk of developing a metabolic disorder, such as type 2 diabetes, lipodystrophy, liver inflammation, fatty liver disease, hypercholesterolemia, elevated liver enzymes (such as, for example, ALT and/or AST), obesity, high blood pressure, and/or elevated triglyceride level (hypertriglyceridemia), and/or a cardiovascular disease, such as cardiomyopathy, heart failure, and high blood pressure. For subjects that are genotyped or determined to be either INHBE reference or heterozygous for an INHBE variant nucleic acid molecule, such subjects or subjects can be treated with an INHBE inhibitor.

In any of the embodiments described herein, the INHBE variant nucleic acid molecule can be any nucleic acid molecule (such as, for example, genomic nucleic acid molecule, mRNA molecule, or cDNA molecule) encoding an INHBE polypeptide having a partial loss-of-function, a complete loss-of-function, a predicted partial loss-of-function, or a predicted complete loss-of-function. In some embodiments, the INHBE variant nucleic acid molecule is associated with a reduced in vitro response to INHBE ligands compared with reference INHBE. In some embodiments, the INHBE variant nucleic acid molecule is an INHBE variant that results or is predicted to result in a premature truncation of an INHBE polypeptide compared to the human reference genome sequence. In some embodiments, the INHBE variant nucleic acid molecule is a variant that is predicted to be damaging by in vitro prediction algorithms such as Polyphen, SIFT, or similar algorithms. In some embodiments, the INHBE variant nucleic acid molecule is a variant that causes or is predicted to cause a nonsynonymous amino-acid substitution in INHBE and whose allele frequency is less than 1/100 alleles in the population from which the subject is selected. In some embodiments, the INHBE variant nucleic acid molecule is any rare missense variant (allele frequency <0.1%; or 1 in 1,000 alleles), or any splice-site, stop-gain, start-loss, stop-loss, frameshift, or in-frame indel, or other frameshift INHBE variant.

In any of the embodiments described herein, the INHBE predicted loss-of-function polypeptide can be any INHBE polypeptide having a partial loss-of-function, a complete loss-of-function, a predicted partial loss-of-function, or a predicted complete loss-of-function.

In any of the embodiments described herein, the INHBE variant nucleic acid molecules encoding variations in the protein sequence can include variations at positions of chromosome 12 using the nucleotide sequence of the INHBE reference genomic nucleic acid molecule (SEQ ID NO:1; ENST00000266646.3 chr12:57455307-57458025 in the GRCh38/hg38 human genome assembly) as a reference sequence.

Numerous genetic variants in INHBE exist which cause subsequent changes in the INHBE polypeptide sequence including, but not limited to: Gln7fs, Arg18STOP, Gln37STOP, Arg40STOP, Leu55fs, Cys139fs, Arg144STOP, Cys192fs, Arg224fs, Arg224STOP, Arg233fs, Arg250STOP, Asp251fs, Tyr253STOP, Tyr275STOP, Ser293fs, Trp308fs, Pro309fs, Arg320STOP, Leu323fs, and Ter351Tyrext*?. Additional variant genomic nucleic acid molecules of INHBE exist, including, but not limited to (using the human genome reference build GRch38): C298+1G:T (12:57455835:G:T), c.299-2A:G, c.299-1G:C (12:57456093:G:C), and 12:57259799:A:C. Additional variant INHBE polypeptides exist, including, but not limited to INHBE polypeptide having the methionine at position 1 removed.

Any one or more (i.e., any combination) of the INHBE pLOF variants can be used within any of the methods described herein to determine whether a subject has an increased risk for developing a metabolic disorder and/or a cardiovascular disease. The combinations of particular variants can form a mask used for statistical analysis of the particular correlation of INHBE and increased type 2 diabetes/BMI risk and/or a cardiovascular disease.

In any of the embodiments described herein, the metabolic disorder is type 2 diabetes, obesity, NASH, and/or elevated triglyceride level. In any of the embodiments described herein, the metabolic disorder is type 2 diabetes. In any of the embodiments described herein, the metabolic disorder is obesity. In any of the embodiments described herein, the metabolic disorder is NASH. In any of the embodiments described herein, the metabolic disorder is elevated triglyceride level. In any of the embodiments described herein, the metabolic disorder is lipodystrophy. In any of the embodiments described herein, the metabolic disorder is liver inflammation. In any of the embodiments described herein, the metabolic disorder is fatty liver disease. In any of the embodiments described herein, the metabolic disorder is hypercholesterolemia. In any of the embodiments described herein, the metabolic disorder is elevated liver enzymes (such as, for example, ALT and/or AST).

Metabolic disorders/conditions associated with body fat distribution also include, but are not limited to: type 2 diabetes, hyperlipidemia or dyslipidemia (high or altered circulating levels of low-density lipoprotein cholesterol (LDL-C), triglycerides, very low-density lipoprotein cholesterol (VLDL-C), apolipoprotein B or other lipid fractions), obesity (particularly abdominal obesity), lipodystrophy (such as an inability to deposit fat in adipose depots regionally (partial lipodystrophy) or in the whole body (lipoatrophy)), insulin resistance or higher or altered insulin levels at fasting or during a glucose or insulin challenge, liver fat deposition or fatty liver disease and their complications (such as, for example, cirrhosis, fibrosis, or inflammation of the liver), higher or elevated or altered liver enzyme levels or other markers of liver damage, inflammation or fat deposition, higher blood pressure and/or hypertension, higher blood sugar or glucose or hyperglycemia, metabolic syndrome, coronary artery disease, and other atherosclerotic conditions, and the complications of each of the aforementioned conditions.

In any of the embodiments described herein, the cardiovascular disease is cardiomyopathy, heart failure, or high blood pressure. In any of the embodiments described herein, the cardiovascular disease is cardiomyopathy. In any of the embodiments described herein, the cardiovascular disease is heart failure. In any of the embodiments described herein, the cardiovascular disease is high blood pressure.

The present disclosure provides methods of treating a subject having or at risk of developing a metabolic disorder, the methods comprising administering an INHBE inhibitor to the subject.

The present disclosure also provides methods of treating a subject having or at risk of developing type 2 diabetes, the methods comprising administering an INHBE inhibitor to the subject.

The present disclosure also provides methods of treating a subject having or at risk of developing obesity, the methods comprising administering an INHBE inhibitor to the subject.

The present disclosure also provides methods of treating a subject having or at risk of developing elevated triglyceride level, the methods comprising administering an INHBE inhibitor to the subject.

The present disclosure also provides methods of treating a subject having or at risk of developing NASH, the methods comprising administering an INHBE inhibitor to the subject.

The present disclosure also provides methods of treating a subject having or at risk of developing lipodystrophy, the methods comprising administering an INHBE inhibitor to the subject.

The present disclosure also provides methods of treating a subject having or at risk of developing liver inflammation, the methods comprising administering an INHBE inhibitor to the subject.

The present disclosure also provides methods of treating a subject having or at risk of developing fatty liver disease, the methods comprising administering an INHBE inhibitor to the subject.

The present disclosure also provides methods of treating a subject having or at risk of developing hypercholesterolemia, the methods comprising administering an INHBE inhibitor to the subject.

The present disclosure also provides methods of treating a subject having or at risk of developing elevated liver enzymes (such as, for example, ALT and/or AST), the methods comprising administering an INHBE inhibitor to the subject.

The present disclosure also provides methods of treating a subject having or at risk of developing a cardiovascular disease, the methods comprising administering an INHBE inhibitor to the subject.

The present disclosure also provides methods of treating a subject having or at risk of developing cardiomyopathy, the methods comprising administering an INHBE inhibitor to the subject.

The present disclosure also provides methods of treating a subject having or at risk of developing heart failure, the methods comprising administering an INHBE inhibitor to the subject.

The present disclosure also provides methods of treating a subject having or at risk of developing high blood pressure, the methods comprising administering an INHBE inhibitor to the subject.

In some embodiments, the INHBE inhibitor comprises an inhibitory nucleic acid molecule. Examples of inhibitory nucleic acid molecules include, but are not limited to, antisense nucleic acid molecules, small interfering RNAs (siRNAs), and short hairpin RNAs (shRNAs). Such inhibitory nucleic acid molecules can be designed to target any region of an INHBE mRNA. In some embodiments, the antisense RNA, siRNA, or shRNA hybridizes to a sequence within an INHBE genomic nucleic acid molecule or mRNA molecule and decreases expression of the INHBE polypeptide in a cell in the subject. In some embodiments, the INHBE inhibitor comprises an antisense RNA that hybridizes to an INHBE genomic nucleic acid molecule or mRNA molecule and decreases expression of the INHBE polypeptide in a cell in the subject. In some embodiments, the INHBE inhibitor comprises an siRNA that hybridizes to an INHBE genomic nucleic acid molecule or mRNA molecule and decreases expression of the INHBE polypeptide in a cell in the subject. In some embodiments, the INHBE inhibitor comprises an shRNA that hybridizes to an INHBE genomic nucleic acid molecule or mRNA molecule and decreases expression of the INHBE polypeptide in a cell in the subject.

In some embodiments, the antisense nucleic acid molecules comprise or consist of the nucleotide sequences shown in Table 1.

TABLE 1

| Sequence | SEQ ID NO: |
|---|---|
| ACAGCUCAUGUCUGGCUACU | 30 |
| UGACCCUCACAGCUCAUGUC | 31 |
| UUGACCCUCACAGCUCAUGU | 32 |
| UGCUUGACCCUCACAGCUCA | 33 |
| GUGCUUGACCCUCACAGCUC | 34 |
| UAGCUGUGCUUGACCCUCAC | 35 |
| AUAGCUGUGCUUGACCCUCA | 36 |
| GAUAGCUGUGCUUGACCCUC | 37 |
| GGAUAGCUGUGCUUGACCCU | 38 |
| UGGAUAGCUGUGCUUGACCC | 39 |
| AUGGAUAGCUGUGCUUGACC | 40 |
| GAUGGAUAGCUGUGCUUGAC | 41 |
| UGAUGGAUAGCUGUGCUUGA | 42 |
| AUCUGAUGGAUAGCUGUGCU | 43 |
| CAUCUGAUGGAUAGCUGUGC | 44 |
| AUCAUCUGAUGGAUAGCUGU | 45 |
| GAUCAUCUGAUGGAUAGCUG | 46 |
| AGAUCAUCUGAUGGAUAGCU | 47 |
| UAGAUCAUCUGAUGGAUAGC | 48 |
| GUAGAUCAUCUGAUGGAUAG | 49 |
| GAAAGUAGAUCAUCUGAUGG | 50 |
| GCUGAAAGUAGAUCAUCUGA | 51 |
| AGGCUGAAAGUAGAUCAUCU | 52 |
| AAGGCUGAAAGUAGAUCAUC | 53 |
| GAAGGCUGAAAGUAGAUCAU | 54 |
| GGAAGGCUGAAAGUAGAUCA | 55 |
| AGGAAGGCUGAAAGUAGAUC | 56 |
| GUCUGGGACUCAGGAAGGCU | 57 |
| UAUUGUCUGGGACUCAGGAA | 58 |
| CUAUUGUCUGGGACUCAGGA | 59 |
| UCUAUUGUCUGGGACUCAGG | 60 |
| CUUCUAUUGUCUGGGACUCA | 61 |
| UCUUCUAUUGUCUGGGACUC | 62 |
| CACCUGUCUUCUAUUGUCUG | 63 |
| CCACCUGUCUUCUAUUGUCU | 64 |
| GCCACCUGUCUUCUAUUGUC | 65 |
| AGCCACCUGUCUUCUAUUGU | 66 |
| AUGAGGGCACAGUGACAGCA | 67 |
| CAAUGAGGGCACAGUGACAG | 68 |

TABLE 1-continued

| Sequence | SEQ ID NO: |
|---|---|
| CCAAUGAGGGCACAGUGACA | 69 |
| CGUCUGUUGAGCUGAUUGC | 70 |
| CCGUCUGUUGAGUCUGAUUG | 71 |
| UCCGUCUGUUGAGUCUGAUU | 72 |
| CUCCGUCUGUUGAGUCUGAU | 73 |
| GCUCCGUCUGUUGAGUCUGA | 74 |
| UGCUCCGUCUGUUGAGUCUG | 75 |
| UUGCUCCGUCUGUUGAGUCU | 76 |
| AGUUGCUCCGUCUGUUGAGU | 77 |
| GCAGUUGCUCCGUCUGUUGA | 78 |
| GGCAGUUGCUCCGUCUGUUG | 79 |
| GAUGGCAGUUGCUCCGUCUG | 80 |
| GGAUGGCAGUUGCUCCGUCU | 81 |
| AGCCUCGGAUGGCAGUUGCU | 82 |
| AGGAGCCUCGGAUGGCAGUU | 83 |
| UUCAGGAGCCUCGGAUGGCA | 84 |
| UGGUUCAGGAGCCUCGGAUG | 85 |
| CUGGUUCAGGAGCCUCGGAU | 86 |
| CUGGUGAAUGGCCCUGGUUC | 87 |
| CCUGGUGAAUGGCCCUGGUU | 88 |
| UCCUGGUGAAUGGCCCUGGU | 89 |
| UGGACAUCAGGGAGCCGCAU | 90 |
| AGGAUUUGCUGCUUGGCUAG | 91 |
| CAGGAUUUGCUGCUUGGCUA | 92 |
| UCCAGGAUUUGCUGCUUGGC | 93 |
| ACCCAUCCAGGAUUUGCUGC | 94 |
| AACCCAUCCAGGAUUUGCUG | 95 |
| CAACCCAUCCAGGAUUUGCU | 96 |
| UGCAACCCAUCCAGGAUUUG | 97 |
| GUGCAACCCAUCCAGGAUUU | 98 |
| GGUGCAACCCAUCCAGGAUU | 99 |
| AGGUGCAACCCAUCCAGGAU | 100 |
| CAGGUGCAACCCAUCCAGGA | 101 |
| UCAGGUGCAACCCAUCCAGG | 102 |
| GUCAGGUGCAACCCAUCCAG | 103 |
| GGUCAGGUGCAACCCAUCCA | 104 |
| UGGUCAGGUGCAACCCAUCC | 105 |
| CUGGUCAGGUGCAACCCAUC | 106 |

TABLE 1-continued

| Sequence | SEQ ID NO: |
|---|---|
| ACUGGUCAGGUGCAACCCAU | 107 |
| GACUGGUCAGGUGCAACCCA | 108 |
| ACGACUGGUCAGGUGCAACC | 109 |
| GACGACUGGUCAGGUGCAAC | 110 |
| GGACGACUGGUCAGGUGCAA | 111 |
| UCUGGGACGACUGGUCAGGU | 112 |
| UUCUGGGACGACUGGUCAGG | 113 |
| AUUCUGGGACGACUGGUCAG | 114 |
| UAUUCUGGGACGACUGGUCA | 115 |
| UUAUUCUGGGACGACUGGUC | 116 |
| GUUAUUCUGGGACGACUGGU | 117 |
| AGUUAUUCUGGGACGACUGG | 118 |
| GAGUUAUUCUGGGACGACUG | 119 |
| UGAGUUAUUCUGGGACGACU | 120 |
| AUGAGUUAUUCUGGGACGAC | 121 |
| GAUGAGUUAUUCUGGGACGA | 122 |
| GGAUGAGUUAUUCUGGGACG | 123 |
| UGGAGGAUGAGUUAUUCUGG | 124 |
| GUGGAGGAUGAGUUAUUCUG | 125 |
| GGUGGAGGAUGAGUUAUUCU | 126 |
| GGGUGGAGGAUGAGUUAUUC | 127 |
| AAAGCUGAUGACCUCCUCCC | 128 |
| CAAAGCUGAUGACCUCCUCC | 129 |
| AGCAAAGCUGAUGACCUCCU | 130 |
| UAGCAAAGCUGAUGACCUCC | 131 |
| GUAGCAAAGCUGAUGACCUC | 132 |
| AGUAGCAAAGCUGAUGACCU | 133 |
| ACAGUAGCAAAGCUGAUGAC | 134 |
| UGACAGUAGCAAAGCUGAUG | 135 |
| GUGACAGUAGCAAAGCUGAU | 136 |
| GUCUGUGACAGUAGCAAAGC | 137 |
| AGUCUGUGACAGUAGCAAAG | 138 |
| GAGUCUGUGACAGUAGCAAA | 139 |
| UGGAGUCUGUGACAGUAGCA | 140 |
| GUGGAGUCUGUGACAGUAGC | 141 |
| AGUGGAGUCUGUGACAGUAG | 142 |
| AAGUGGAGUCUGUGACAGUA | 143 |
| UGAAGUGGAGUCUGUGACAG | 144 |
| CUGAAGUGGAGUCUGUGACA | 145 |

TABLE 1-continued

| Sequence | SEQ ID NO: |
|---|---|
| GCUGAAGUGGAGUCUGUGAC | 146 |
| GGCUGAAGUGGAGUCUGUGA | 147 |
| AGGCUGAAGUGGAGUCUGUG | 148 |
| UAGGCUGAAGUGGAGUCUGU | 149 |
| GUAGGCUGAAGUGGAGUCUG | 150 |
| GCUGUAGGCUGAAGUGGAGU | 151 |
| AGCUGUAGGCUGAAGUGGAG | 152 |
| GAGCUGUAGGCUGAAGUGGA | 153 |
| GGGAGCUGUAGGCUGAAGUG | 154 |
| AGGGAGCUGUAGGCUGAAGU | 155 |
| AAGUGAGCAGGGAGCUGUAG | 156 |
| UGGACAGGUGAAAAGUGAGC | 157 |
| GUGGACAGGUGAAAAGUGAG | 158 |
| AGUGGACAGGUGAAAAGUGA | 159 |
| GAGUGGACAGGUGAAAAGUG | 160 |
| GGAGUGGACAGGUGAAAAGU | 161 |
| AGGAGUGGACAGGUGAAAAG | 162 |
| GAGGAGUGGACAGGUGAAAA | 163 |
| CGAGGAGUGGACAGGUGAAA | 164 |
| CCGAGGAGUGGACAGGUGAA | 165 |
| ACCGAGGAGUGGACAGGUGA | 166 |
| CAUGGUACAGGUGGUGGGAC | 167 |
| GCAUGGUACAGGUGGUGGGA | 168 |
| CAAAGAGUGCCAGGAAGGGU | 169 |
| GCAAAGAGUGCCAGGAAGGG | 170 |
| AAGCAAAGAGUGCCAGGAAG | 171 |
| UCAAGCAAAGAGUGCCAGGA | 172 |
| CUCAAGCAAAGAGUGCCAGG | 173 |
| CCUCAAGCAAAGAGUGCCAG | 174 |
| AUCCUCAAGCAAAGAGUGCC | 175 |
| GAUCCUCAAGCAAAGAGUGC | 176 |
| GAAGAUCCUCAAGCAAAGAG | 177 |
| GGAAGAUCCUCAAGCAAAGA | 178 |
| CGGAAGAUCCUCAAGCAAAG | 179 |
| AUCGGAAGAUCCUCAAGCAA | 180 |
| CAUCGGAAGAUCCUCAAGCA | 181 |
| CCAUCGGAAGAUCCUCAAGC | 182 |
| CCCAUCGGAAGAUCCUCAAG | 183 |

TABLE 1-continued

| Sequence | SEQ ID NO: |
|---|---|
| AUGUGGUGCUCAGCCAGGAG | 184 |
| UUGGUGAUGUGGUGCUCAGC | 185 |
| GGUUGGUGAUGUGGUGCUCA | 186 |
| AGGUUGGUGAUGUGGUGCUC | 187 |
| CAGGUUGGUGAUGUGGUGCU | 188 |
| AGCCCAGGUUGGUGAUGUGG | 189 |
| CAGCCCAGGUUGGUGAUGUG | 190 |
| UGCCAGCCCAGGUUGGUGAU | 191 |
| AUGCCAGCCCAGGUUGGUGA | 192 |
| GUAUGCCAGCCCAGGUUGGU | 193 |
| AGGUAUGCCAGCCCAGGUUG | 194 |
| AAGGUAUGCCAGCCCAGGUU | 195 |
| UAAGGUAUGCCAGCCCAGGU | 196 |
| UUAAGGUAUGCCAGCCCAGG | 197 |
| GUUAAGGUAUGCCAGCCCAG | 198 |
| AGUUAAGGUAUGCCAGCCCA | 199 |
| GAGUUAAGGUAUGCCAGCCC | 200 |
| AGAGUUAAGGUAUGCCAGCC | 201 |
| CAGAGUUAAGGUAUGCCAGC | 202 |
| GCAGAGUUAAGGUAUGCCAG | 203 |
| AGGGCAGAGUUAAGGUAUGC | 204 |
| AGAGGGCAGAGUUAAGGUAU | 205 |
| UAGAGGGCAGAGUUAAGGUA | 206 |
| CUAGAGGGCAGAGUUAAGGU | 207 |
| CACUAGAGGGCAGAGUUAAG | 208 |
| GCCACUAGAGGGCAGAGUUA | 209 |
| GGACACCAGACUUCUCACCC | 210 |
| AGGACACCAGACUUCUCACC | 211 |
| CAGGACACCAGACUUCUCAC | 212 |
| UUUCAGGACACCAGACUUCU | 213 |
| GUUUCAGGACACCAGACUUC | 214 |
| UAGUUGCAGUUUCAGGACAC | 215 |
| CUAGUUGCAGUUUCAGGACA | 216 |
| UCUAGUUGCAGUUUCAGGAC | 217 |
| GUCUAGUUGCAGUUUCAGGA | 218 |
| AGUCUAGUUGCAGUUUCAGG | 219 |
| CAGUCUAGUUGCAGUUUCAG | 220 |
| AACUGUGCUGUUGCCUUCUA | 221 |
| UAACUGUGCUGUUGCCUUCU | 222 |

TABLE 1-continued

| Sequence | SEQ ID NO: |
|---|---|
| GUAACUGUGCUGUUGCCUUC | 223 |
| CCAGUAACUGUGCUGUUGCC | 224 |
| GUCCAGUAACUGUGCUGUUG | 225 |
| UGUCCAGUAACUGUGCUGUU | 226 |
| UUGUCCAGUAACUGUGCUGU | 227 |
| GGUUGUCCAGUAACUGUGCU | 228 |
| CGGUUGUCCAGUAACUGUGC | 229 |
| UCGGUUGUCCAGUAACUGUG | 230 |
| CUCGGUUGUCCAGUAACUGU | 231 |
| CCUCGGUUGUCCAGUAACUG | 232 |
| GCCUCGGUUGUCCAGUAACU | 233 |
| CGCCUCGGUUGUCCAGUAAC | 234 |
| CCGCCUCGGUUGUCCAGUAA | 235 |
| UGCUGGUGUCCUGCUGUGUC | 236 |
| CUGCUGGUGUCCUGCUGUGU | 237 |
| UCUAGGAAGGGCUGCUGGUG | 238 |
| UUAAGCUCUAGGAAGGGCUG | 239 |
| CUCAUUGGCUCGGAUCUUAA | 240 |
| GCUCAUUGGCUCGGAUCUUA | 241 |
| GGCUCAUUGGCUCGGAUCUU | 242 |
| AGGCUCAUUGGCUCGGAUCU | 243 |
| CAGGCUCAUUGGCUCGGAUC | 244 |
| UCCAGGCUCAUUGGCUCGGA | 245 |
| UCUCGCCUGCAACAUAAGGG | 246 |
| CAGAAUGGAAAGAGGCAGCA | 247 |
| GCAGAAUGGAAAGAGGCAGC | 248 |
| AAGACGGCAGAAUGGAAAGA | 249 |
| GAAGACGGCAGAAUGGAAAG | 250 |
| UGAAGACGGCAGAAUGGAAA | 251 |
| CUGAAGACGGCAGAAUGGAA | 252 |
| GCUGAAGACGGCAGAAUGGA | 253 |
| GGCUGAAGACGGCAGAAUGG | 254 |
| AGGCUGAAGACGGCAGAAUG | 255 |
| GGAGGCUGAAGACGGCAGAA | 256 |
| AGGAGGCUGAAGACGGCAGA | 257 |
| UGUUGGCUUUGAGGAGGCUG | 258 |
| CAAGGAUUGUUGGCUUUGAG | 259 |
| UGGCAGGCCAAGGAUUGUUG | 260 |

TABLE 1-continued

| Sequence | SEQ ID NO: |
|---|---|
| CUGGCAGGCCAAGGAUUGUU | 261 |
| ACUGGCAGGCCAAGGAUUGU | 262 |
| AGGAGGUACUGGCAGGCCAA | 263 |
| AACAGGAGGUACUGGCAGGC | 264 |
| CAACAGGAGGUACUGGCAGG | 265 |
| ACACAACAGGAGGUACUGGC | 266 |
| AGGGACACAACAGGAGGUAC | 267 |
| UCGGGCAGUAGGGACACAAC | 268 |
| UUCGGGCAGUAGGGACACAA | 269 |
| CUUCGGGCAGUAGGGACACA | 270 |
| AUGAUCCAGGUAGAGGAGAG | 271 |
| UAUGAUCCAGGUAGAGGAGA | 272 |
| UUAUGAUCCAGGUAGAGGAG | 273 |
| AUUAUGAUCCAGGUAGAGGA | 274 |
| CAUUAUGAUCCAGGUAGAGG | 275 |
| CCAUUAUGAUCCAGGUAGAG | 276 |
| UGCCAUUAUGAUCCAGGUAG | 277 |
| UUGCCAUUAUGAUCCAGGUA | 278 |
| AUUGCCAUUAUGAUCCAGGU | 279 |
| CAUUGCCAUUAUGAUCCAGG | 280 |
| ACAUUGCCAUUAUGAUCCAG | 281 |
| CCACAUUGCCAUUAUGAUCC | 282 |
| GACCACAUUGCCAUUAUGAU | 283 |
| UGACCACAUUGCCAUUAUGA | 284 |
| UUGACCACAUUGCCAUUAUG | 285 |
| UCUUGACCACAUUGCCAUUA | 286 |
| GUCUUGACCACAUUGCCAUU | 287 |
| CGUCUUGACCACAUUGCCAU | 288 |
| CCGUCUUGACCACAUUGCCA | 289 |
| UCCGUCUUGACCACAUUGCC | 290 |
| AUCCGUCUUGACCACAUUGC | 291 |
| CAUCCGUCUUGACCACAUUG | 292 |
| ACAUCCGUCUUGACCACAUU | 293 |
| CACAUCCGUCUUGACCACAU | 294 |
| GCACAUCCGUCUUGACCACA | 295 |
| GGCACAUCCGUCUUGACCAC | 296 |
| UGGCACAUCCGUCUUGACCA | 297 |
| CUGGCACAUCCGUCUUGACC | 298 |
| UCUGGCACAUCCGUCUUGAC | 299 |

TABLE 1-continued

| Sequence | SEQ ID NO: |
|---|---|
| AUCUGGCACAUCCGUCUUGA | 300 |
| UAUCUGGCACAUCCGUCUUG | 301 |
| AUAUCUGGCACAUCCGUCUU | 302 |
| CAUAUCUGGCACAUCCGUCU | 303 |
| CCAUAUCUGGCACAUCCGUC | 304 |
| CACCAUAUCUGGCACAUCCG | 305 |
| CUCCACCACCAUAUCUGGCA | 306 |
| UGGUCUCUUCACUCCAAAGC | 307 |
| CUUCAUCUUGGUCUCUUCAC | 308 |
| ACUUCAUCUUGGUCUCUUCA | 309 |
| AACUUCAUCUUGGUCUCUUC | 310 |
| GGAAACUUCAUCUUGGUCUC | 311 |
| CCUCCAGUCACAGAUGCCCU | 312 |
| GAUGCCUCCAGUCACAGAUG | 313 |
| UGAUGCCUCCAGUCACAGAU | 314 |
| CAGGUGGUUGUUGGGUUGGG | 315 |
| CCAGGUGGUUGUUGGGUUGG | 316 |
| GCCAGGUGGUUGUUGGGUUG | 317 |
| UGCCAGGUGGUUGUUGGGUU | 318 |
| CAUAUUGCCAGGUGGUUGUU | 319 |
| UCAUAUUGCCAGGUGGUUGU | 320 |
| GUCAUAUUGCCAGGUGGUUG | 321 |
| AGUCAUAUUGCCAGGUGGUU | 322 |
| GAGUCAUAUUGCCAGGUGGU | 323 |
| AGUGAGUCAUAUUGCCAGGU | 324 |
| AAGUGAGUCAUAUUGCCAGG | 325 |
| CAAGUGAGUCAUAUUGCCAG | 326 |
| GUCAAGUGAGUCAUAUUGCC | 327 |
| GGUCAAGUGAGUCAUAUUGC | 328 |
| GGGUCAAGUGAGUCAUAUUG | 329 |
| CCCAUUUGGGUCCCAUAGGG | 330 |
| GCCCAUUUGGGUCCCAUAGG | 331 |
| UGCCCAUUUGGGUCCCAUAG | 332 |
| GUGCCCAUUUGGGUCCCAUA | 333 |
| AGUGCCCAUUUGGGUCCCAU | 334 |
| AAGUGCCCAUUUGGGUCCCA | 335 |
| AAAGUGCCCAUUUGGGUCCC | 336 |
| GAAAGUGCCCAUUUGGGUCC | 337 |

TABLE 1-continued

| Sequence | SEQ ID NO: |
|---|---|
| AGAAAGUGCCCAUUUGGGUC | 338 |
| CAAGAAAGUGCCCAUUUGGG | 339 |
| ACAAGAAAGUGCCCAUUUGG | 340 |
| GACAAGAAAGUGCCCAUUUG | 341 |
| GAGUCUCAGACAAGAAAGUG | 342 |
| CCAGAGUCUCAGACAAGAAA | 343 |
| GCCAGAGUCUCAGACAAGAA | 344 |
| AGCCAGAGUCUCAGACAAGA | 345 |
| UAAGCCAGAGUCUCAGACAA | 346 |
| AUAAGCCAGAGUCUCAGACA | 347 |
| AGCCAACCUGGAAUAAGCCA | 348 |
| UCAGCCAACCUGGAAUAAGC | 349 |
| CAUCAGCCAACCUGGAAUAA | 350 |
| CACAUCAGCCAACCUGGAAU | 351 |
| ACACAUCAGCCAACCUGGAA | 352 |
| AACACAUCAGCCAACCUGGA | 353 |
| CAACACAUCAGCCAACCUGG | 354 |
| CUCCAACACAUCAGCCAAC | 355 |
| CGCUUUACCCAUCUCCCAAC | 356 |
| AACGCUUUACCCAUCUCCCA | 357 |
| AAACGCUUUACCCAUCUCCC | 358 |
| AGAAACGCUUUACCCAUCUC | 359 |
| AAGAAACGCUUUACCCAUCU | 360 |
| GAAGAAACGCUUUACCCAUC | 361 |
| AGAAGAAACGCUUUACCCAU | 362 |
| UAGAAGAAACGCUUUACCCA | 363 |
| UUAGAAGAAACGCUUUACCC | 364 |
| AAUCAUGCUUUCUGGGUAGA | 365 |
| CUUAGGGCAGGAAAUCAUGC | 366 |
| ACUUAGGGCAGGAAAUCAUG | 367 |
| GACUUAGGGCAGGAAAUCAU | 368 |
| AGGACUUAGGGCAGGAAAUC | 369 |
| CAGGACUUAGGGCAGGAAAU | 370 |
| ACAGGACUUAGGGCAGGAAA | 371 |
| UCUCACAGGACUUAGGGCAG | 372 |
| UUCUCACAGGACUUAGGGCA | 373 |
| AUCUUCUCACAGGACUUAGG | 374 |
| CAUCUUCUCACAGGACUUAG | 375 |
| UAGUCCCUGACAUCUUCUCA | 376 |

TABLE 1-continued

| Sequence | SEQ ID NO: |
|---|---|
| CUAGUCCCUGACAUCUUCUC | 377 |
| CCUAGUCCCUGACAUCUUCU | 378 |
| CCCUAGUCCCUGACAUCUUC | 379 |
| UCCCUAGUCCCUGACAUCUU | 380 |
| CUCCCUAGUCCCUGACAUCU | 381 |
| AUCUAUCUGCUUCCUCCUCC | 382 |
| CCAUCUAUCUGCUUCCUCCU | 383 |
| ACCAUCUAUCUGCUUCCUCC | 384 |
| GACCAUCUAUCUGCUUCCUC | 385 |
| GGACCAUCUAUCUGCUUCCU | 386 |
| UGGACCAUCUAUCUGCUUCC | 387 |
| CUGGACCAUCUAUCUGCUUC | 388 |
| CUGCUGGACCAUCUAUCUGC | 389 |
| GCCUGCUGGACCAUCUAUCU | 390 |
| UUCAAGCCUGCUGGACCAUC | 391 |
| UGCUUCAAGCCUGCUGGACC | 392 |
| CCUCAACAGCCCUUACCCUG | 393 |
| UCCCUCUUGACCUUCCCUUA | 394 |
| CUCCCUCUUGACCUUCCCUU | 395 |
| UCUCCCUCUUGACCUUCCCU | 396 |
| CAUCUCCCUCUUGACCUUCC | 397 |
| CCAUCUCCCUCUUGACCUUC | 398 |
| CCCAUCUCCCUCUUGACCUU | 399 |
| GCCCAUCUCCCUCUUGACCU | 400 |
| UUGCCCAUCUCCCUCUUGAC | 401 |
| CUUGCCCAUCUCCCUCUUGA | 402 |
| CCCUAAGCAUCCUCCCUCAG | 403 |
| AACUUCUUAGGCUUAGUGCC | 404 |
| GGAACUUCUUAGGCUUAGUG | 405 |
| GGGAACUUCUUAGGCUUAGU | 406 |
| AGGGAACUUCUUAGGCUUAG | 407 |
| UGUCUCCCAGUGGGUCCUGU | 408 |
| AGUAUAAAUGCUUGUCUCCC | 409 |
| GACAGAGCGAGACUCGAUCU | 410 |
| UGACAGAGCGAGACUCGAUC | 411 |
| GUGACAGAGCGAGACUCGAU | 412 |
| GGUGACAGAGCGAGACUCGA | 413 |
| UGGUGACAGAGCGAGACUCG | 414 |

TABLE 1-continued

| Sequence | SEQ ID NO: |
|---|---|
| CUGGUGACAGAGCGAGACUC | 415 |
| CCUGGUGACAGAGCGAGACU | 416 |
| AGCCUGGUGACAGAGCGAGA | 417 |
| UGCACUCCAGCCUGGUGACA | 418 |
| ACUGCACUCCAGCCUGGUGA | 419 |
| UCACUGCACUCCAGCCUGGU | 420 |
| UGUCACUGCACUCCAGCCUG | 421 |
| GUGUCACUGCACUCCAGCCU | 422 |
| AGACGGAGGUUGCAGUGAGC | 423 |
| GAGACGGAGGUUGCAGUGAG | 424 |
| GGAGACGGAGGUUGCAGUGA | 425 |
| ACUUGAACCCAGGAGACGGA | 426 |
| CACUUGAACCCAGGAGACGG | 427 |
| UCACUUGAACCCAGGAGACG | 428 |
| AUCACUUGAACCCAGGAGAC | 429 |
| AAUCACUUGAACCCAGGAGA | 430 |
| GAAUCACUUGAACCCAGGAG | 431 |
| AGAAUCACUUGAACCCAGGA | 432 |
| AAGAAUCACUUGAACCCAGG | 433 |
| GAAGAAUCACUUGAACCCAG | 434 |
| AGAAGAAUCACUUGAACCCA | 435 |
| CAGAAGAAUCACUUGAACCC | 436 |
| GCAGAAGAAUCACUUGAACC | 437 |
| GGCAGAAGAAUCACUUGAAC | 438 |
| AGGCAGAAGAAUCACUUGAA | 439 |
| GAGGCAGAAGAAUCACUUGA | 440 |
| UGAGGCAGAAGAAUCACUUG | 441 |
| CUGAGGCAGAAGAAUCACUU | 442 |
| GCUGAGGCAGAAGAAUCACU | 443 |
| GGCUGAGGCAGAAGAAUCAC | 444 |
| AGGCUGAGGCAGAAGAAUCA | 445 |
| GAGGCUGAGGCAGAAGAAUC | 446 |
| GGAGGCUGAGGCAGAAGAAU | 447 |
| GGGAGGCUGAGGCAGAAGAA | 448 |
| AGAUUGAGACCAUCCUGGCC | 449 |
| GAGAUUGAGACCAUCCUGGC | 450 |
| AGAGAUUGAGACCAUCCUGG | 451 |
| AAGAGAUUGAGACCAUCCUG | 452 |
| CAAGAGAUUGAGACCAUCCU | 453 |

TABLE 1-continued

| Sequence | SEQ ID NO: |
|---|---|
| GGUGGCUCACGCCUAUAAUC | 454 |
| CGGUGGCUCACGCCUAUAAU | 455 |
| GCGGUGGCUCACGCCUAUAA | 456 |
| CCCUAACCCUUCUUUAUGAC | 457 |
| CACCCUAACCCUUCUUUAUG | 458 |
| AUCACCCUAACCCUUCUUUA | 459 |
| CAUCACCCUAACCCUUCUUU | 460 |
| CCAUCACCCUAACCCUUCUU | 461 |
| GACCAUCACCCUAACCCUUC | 462 |
| GGACCAUCACCCUAACCCUU | 463 |
| UGGACCAUCACCCUAACCCU | 464 |
| CUGGACCAUCACCCUAACCC | 465 |
| UCUGGACCAUCACCCUAACC | 466 |
| CUCUGGACCAUCACCCUAAC | 467 |
| GCUCUGGACCAUCACCCUAA | 468 |
| UGCUCUGGACCAUCACCCUA | 469 |
| GUUGCUCUGGACCAUCACCC | 470 |
| UGUUGCUCUGGACCAUCACC | 471 |
| ACUGUUGCUCUGGACCAUCA | 472 |
| AACUGUUGCUCUGGACCAUC | 473 |
| GAACUGUUGCUCUGGACCAU | 474 |
| GAAGAACUGUUGCUCUGGAC | 475 |
| UUGAAGAACUGUUGCUCUGG | 476 |
| ACUUGAAGAACUGUUGCUCU | 477 |
| CACUUGAAGAACUGUUGCUC | 478 |
| UACACUUGAAGAACUGUUGC | 479 |
| GAGUACACUUGAAGAACUGU | 480 |
| AGAGUACACUUGAAGAACUG | 481 |
| CAGAGUACACUUGAAGAACU | 482 |
| ACAGAGUACACUUGAAGAAC | 483 |
| CUACAGAGUACACUUGAAGA | 484 |
| CCUACAGAGUACACUUGAAG | 485 |
| GCCUACAGAGUACACUUGAA | 486 |
| AGCCUACAGAGUACACUUGA | 487 |
| AAGCCUACAGAGUACACUUG | 488 |
| CAGAAGCCUACAGAGUACAC | 489 |
| CCAGAAGCCUACAGAGUACA | 490 |
| AAAAGGGACCUCCCAGAAGC | 491 |

TABLE 1-continued

| Sequence | SEQ ID NO: |
| --- | --- |
| GAAAAGGGACCUCCCAGAAG | 492 |
| UGAAAAGGGACCUCCCAGAA | 493 |
| CUUUGACUUUGUGGACACCC | 494 |
| GCUUUGACUUUGUGGACACC | 495 |
| UAGCUUUGACUUUGUGGACA | 496 |
| AUAGCUUUGACUUUGUGGAC | 497 |
| GUCACACGGCCUCUGGAAAA | 498 |
| UGUCACACGGCCUCUGGAAA | 499 |
| AUGUCACACGGCCUCUGGAA | 500 |

In some embodiments, the antisense nucleic acid molecules comprise or consist of the nucleotide sequences shown in Table 2.

TABLE 2

| Sequence | SEQ ID NO: |
| --- | --- |
| CUUAGUCACUUUUCCCAAGA | 501 |
| UCUUAGUCACUUUUCCCAAG | 502 |
| CUCUUAGCAUCUUAGUCACU | 503 |
| GCUCUUAGCAUCUUAGUCAC | 504 |
| UACGCUCUUAGCAUCUUAGU | 505 |
| AUACGCUCUUAGCAUCUUAG | 506 |
| CUCAGCUAUAAAUACGCUCU | 507 |
| GCUCAGCUAUAAAUACGCUC | 508 |
| AGCUCAGCUAUAAAUACGCU | 509 |
| ACCCUCACUGUCAGAUGCCC | 510 |
| CACCCUCACUGUCAGAUGCC | 511 |
| CCCACCCUCACUGUCAGAUG | 512 |
| GGGAAGUGACAAGAAGUGGC | 513 |
| GUAUCAGUAGGCAGUCAGGG | 514 |
| GGUAUCAGUAGGCAGUCAGG | 515 |
| GUUGGUAUCAGUAGGCAGUC | 516 |
| UGUUGGUAUCAGUAGGCAGU | 517 |
| CCUGUUGGUAUCAGUAGGCA | 518 |
| ACCUGUUGGUAUCAGUAGGC | 519 |
| CAGACGGCUUACCUGUUGGU | 520 |
| UCAGACGGCUUACCUGUUGG | 521 |
| CUCAGACGGCUUACCUGUUG | 522 |
| CCUCAGACGGCUUACCUGUU | 523 |
| GCCUCAGACGGCUUACCUGU | 524 |

TABLE 2-continued

| Sequence | SEQ ID NO: |
| --- | --- |
| UGCCUCAGACGGCUUACCUG | 525 |
| GUGCCUCAGACGGCUUACCU | 526 |
| UGGUGCCUCAGACGGCUUAC | 527 |
| GUGGUGCCUCAGACGGCUUA | 528 |
| AGCAAAGUGGAGGUAUCUAU | 529 |
| GUCAGCAAAGUGGAGGUAUC | 530 |
| GGUCAGCAAAGUGGAGGUAU | 531 |
| UUGGUCAGCAAAGUGGAGGU | 532 |
| AUUGGUCAGCAAAGUGGAGG | 533 |
| CAUUGGUCAGCAAAGUGGAG | 534 |
| ACAUUGGUCAGCAAAGUGGA | 535 |
| AACAUUGGUCAGCAAAGUGG | 536 |
| UGGAACAUUGGUCAGCAAAG | 537 |
| UCUGGAACAUUGGUCAGCAA | 538 |
| GGUCUGGAACAUUGGUCAGC | 539 |
| GGGUCUGGAACAUUGGUCAG | 540 |
| CGGGUCUGGAACAUUGGUCA | 541 |
| UCGGGUCUGGAACAUUGGUC | 542 |
| CUCGGGUCUGGAACAUUGGU | 543 |
| GGAAAUGACAGCCCUCUACC | 544 |
| GGGAAAUGACAGCCCUCUAC | 545 |
| UGGGAAAUGACAGCCCUCUA | 546 |
| GGUUGGGCUGGGAAAUGACA | 547 |
| UUGGUUGGGCUGGGAAAUGA | 548 |
| UGUUGGUUGGGCUGGGAAAU | 549 |
| UCUGUUGGUUGGGCUGGGAA | 550 |
| AUUCUGUUGGUUGGGCUGGG | 551 |
| CUCCCAGCAACCAUUCUGUU | 552 |
| GCUCCCAGCAACCAUUCUGU | 553 |
| AGCUCCCAGCAACCAUUCUG | 554 |
| AGCUCUGUCCAGUGUUCUCC | 555 |
| CUGUCCACCCUGCAUUUCUC | 556 |
| AUUAGACCCUCCUGUCCACC | 557 |
| GAUUAGACCCUCCUGUCCAC | 558 |
| CGAUUAGACCCUCCUGUCCA | 559 |
| ACGAUUAGACCCUCCUGUCC | 560 |
| GACGAUUAGACCCUCCUGUC | 561 |
| AGACGAUUAGACCCUCCUGU | 562 |
| GAGACGAUUAGACCCUCCUG | 563 |

TABLE 2-continued

| Sequence | SEQ ID NO: |
|---|---|
| UGAGACGAUUAGACCCUCCU | 564 |
| CUGAGACGAUUAGACCCUCC | 565 |
| ACUGAGACGAUUAGACCCUC | 566 |
| CACUGAGACGAUUAGACCCU | 567 |
| GCACUGAGACGAUUAGACCC | 568 |
| CGCACUGAGACGAUUAGACC | 569 |
| GCGCACUGAGACGAUUAGAC | 570 |
| GGCGCACUGAGACGAUUAGA | 571 |
| ACCUCAGGGCACUCUUUGGU | 572 |
| AACCUCAGGGCACUCUUUGG | 573 |
| GAACCUCAGGGCACUCUUUG | 574 |
| AGAACCUCAGGGCACUCUUU | 575 |
| UAGAACCUCAGGGCACUCUU | 576 |
| CUAGAACCUCAGGGCACUCU | 577 |
| CCUAGAACCUCAGGGCACUC | 578 |
| UCCUAGAACCUCAGGGCACU | 579 |
| GCUCUUCCUAGAACCUCAGG | 580 |
| CCAGGCUCUUCCUAGAACCU | 581 |
| ACCAGGCUCUUCCUAGAACC | 582 |
| UACCAGGCUCUUCCUAGAAC | 583 |
| GUACCAGGCUCUUCCUAGAA | 584 |
| UGUACCAGGCUCUUCCUAGA | 585 |
| AUGUACCAGGCUCUUCCUAG | 586 |
| UGAUGUACCAGGCUCUUCCU | 587 |
| GGUGAUGUACCAGGCUCUUC | 588 |
| AUGGAGCUUGGUGAUGUACC | 589 |
| UGGCAAUGGAGCUUGGUGAU | 590 |
| GUGGCAAUGGAGCUUGGUGA | 591 |
| CGUGGCAAUGGAGCUUGGUG | 592 |
| ACGUGGCAAUGGAGCUUGGU | 593 |
| ACCUUUGGUUUUGGACCUCA | 594 |
| UACCUUUGGUUUUGGACCUC | 595 |
| CUACCUUUGGUUUUGGACCU | 596 |
| GCUACCUUUGGUUUUGGACC | 597 |
| ACUGCUACCUUUGGUUUUGG | 598 |
| CACUGCUACCUUUGGUUUUG | 599 |
| UCACUGCUACCUUUGGUUUU | 600 |
| AUCACUGCUACCUUUGGUUU | 601 |
| GAGAGACUGUCUUCAGGAUC | 602 |
| ACACUGCCAGAGAAGAGAGA | 603 |
| CACACUGCCAGAGAAGAGAG | 604 |
| AGCUGGUUCCUUUGUUCUUU | 605 |
| GGGACAAGCUGGUUCCUUUG | 606 |
| AGGGACAAGCUGGUUCCUUU | 607 |
| CAGGGACAAGCUGGUUCCUU | 608 |
| GACAGGGACAAGCUGGUUCC | 609 |
| AGACAGGGACAAGCUGGUUC | 610 |
| AAGACAGGGACAAGCUGG | 611 |
| CAAGAGACAGGGACAAGCUG | 612 |
| ACAAGAGACAGGGACAAGCU | 613 |
| AUGGAGUGAUGAGGAGUGCC | 614 |
| CUGGCUUGUAGCUGGCUGGA | 615 |
| CCACCAGUGUCCACCAUGUG | 616 |
| AGUACCACCAGUGUCCACCA | 617 |
| CAGUACCACCAGUGUCCACC | 618 |
| CCUCAGUACCACCAGUGUCC | 619 |
| GACCUCAGUACCACCAGUGU | 620 |
| UGGACCUCAGUACCACCAGU | 621 |
| GCUGGACCUCAGUACCACCA | 622 |
| AAGGCUGGACCUCAGUACCA | 623 |
| GAAGGCUGGACCUCAGUACC | 624 |
| GGAAGGCUGGACCUCAGUAC | 625 |
| UUGGAAGGCUGGACCUCAGU | 626 |
| AUUGGAAGGCUGGACCUCAG | 627 |
| AAUUGGAAGGCUGGACCUCA | 628 |
| CUAAUUGGAAGGCUGGACCU | 629 |
| CCUAAUUGGAAGGCUGGACC | 630 |
| UCCUAAUUGGAAGGCUGGAC | 631 |
| CUGUCAAGAGAGACUAUUAG | 632 |
| GCUGUCAAGAGAGACUAUUA | 633 |
| GGCUGUCAAGAGAGACUAUU | 634 |
| GGGCUGUCAAGAGAGACUAU | 635 |
| CCCUCUGUUUAGAUGAUGGG | 636 |
| CUCCACUUUGCUCAUCUCCC | 637 |
| UACUCCACUUUGCUCAUCUC | 638 |
| UUACUCCACUUUGCUCAUCU | 639 |
| UUUACUCCACUUUGCUCAUC | 640 |

TABLE 2-continued

| Sequence | SEQ ID NO: |
|---|---|
| CUUUACUCCACUUUGCUCAU | 641 |
| UCUUUACUCCACUUUGCUCA | 642 |
| GUCUUUACUCCACUUUGCUC | 643 |
| GAAAUGUGUCUUUACUCCAC | 644 |
| GUGUGAUUUGGAAAUGUGUC | 645 |
| GUGGGUGUGAUUUGGAAAUG | 646 |
| AGUGGGUGUGAUUUGGAAAU | 647 |
| GAAGGUGGGCCUCAUGCUAG | 648 |
| CACCACACCCAGUCCUCACU | 649 |
| AUGAGCCACCACACCCAGUC | 650 |
| CAUGAGCCACCACACCCAGU | 651 |
| ACAUGAGCCACCACACCCAG | 652 |
| GACAUGAGCCACCACACCCA | 653 |
| AGACAUGAGCCACCACACCC | 654 |
| UAGACAUGAGCCACCACACC | 655 |
| AUAGACAUGAGCCACCACAC | 656 |
| GCUCAAGCGAUCCUCUCACC | 657 |
| GGCUCAAGCGAUCCUCUCAC | 658 |
| GGGCUCAAGCGAUCCUCUCA | 659 |
| UGGGCUCAAGCGAUCCUCUC | 660 |
| CUGGGCUCAAGCGAUCCUCU | 661 |
| UCUUUUGUAGAGACAGGGUC | 662 |
| UUCUUUUGUAGAGACAGGGU | 663 |
| AUUCUUUUGUAGAGACAGGG | 664 |
| ACACCACACAGGCUAAUUUA | 665 |
| UGCCACCACACCAACCACAC | 666 |
| GUGCCACCACACCAACCACA | 667 |
| GCUAAGUCUACAGGUGCGUG | 668 |
| UUGACCUCCUGGGUUAAGUG | 669 |
| CUUGACCUCCUGGGUUAAGU | 670 |
| GCCUUGACCUCCUGGGUUAA | 671 |
| UACAGGCAUGAGCCACCGCA | 672 |
| UUACAGGCAUGAGCCACCGC | 673 |
| AUUACAGGCAUGAGCCACCG | 674 |
| GAUUACAGGCAUGAGCCACC | 675 |
| GGAUUACAGGCAUGAGCCAC | 676 |
| GGGAUUACAGGCAUGAGCCA | 677 |
| UGGGAUUACAGGCAUGAGCC | 678 |
| CUGGGAUUACAGGCAUGAGC | 679 |
| GCUGGGAUUACAGGCAUGAG | 680 |
| UGCUGGGAUUACAGGCAUGA | 681 |
| GUGCUGGGAUUACAGGCAUG | 682 |
| AGUGCUGGGAUUACAGGCAU | 683 |
| AAGUGCUGGGAUUACAGGCA | 684 |
| AAAGUGCUGGGAUUACAGGC | 685 |
| CAAAGUGCUGGGAUUACAGG | 686 |
| CCAAAGUGCUGGGAUUACAG | 687 |
| GUUAGCCAGGAUGGUCUCCA | 688 |
| UGUUAGCCAGGAUGGUCUCC | 689 |
| GUGUUAGCCAGGAUGGUCUC | 690 |
| UGUGUUAGCCAGGAUGGUCU | 691 |
| CUGUGUUAGCCAGGAUGGUC | 692 |
| ACUGUGUUAGCCAGGAUGGU | 693 |
| CACUGUGUUAGCCAGGAUGG | 694 |
| UCACUGUGUUAGCCAGGAUG | 695 |
| UUCACUGUGUUAGCCAGGAU | 696 |
| UUUCACUGUGUUAGCCAGGA | 697 |
| GUUUCACUGUGUUAGCCAGG | 698 |
| GGUUUCACUGUGUUAGCCAG | 699 |
| GGGUUUCACUGUGUUAGCCA | 700 |
| UUCUUCUGCCUCAGCCUCCC | 701 |
| AUUCUUCUGCCUCAGCCUCC | 702 |
| CAUUCUUCUGCCUCAGCCUC | 703 |
| CCAUUCUUCUGCCUCAGCCU | 704 |
| ACCAUUCUUCUGCCUCAGCC | 705 |
| CACCAUUCUUCUGCCUCAGC | 706 |
| ACACCAUUCUUCUGCCUCAG | 707 |
| CUCACUGCAAGCUCCACCUC | 708 |
| GCUCACUGCAAGCUCCACCU | 709 |
| UCGGCUCACUGCAAGCUCCA | 710 |
| UCUCGGCUCACUGCAAGCUC | 711 |
| AUCUCGGCUCACUGCAAGCU | 712 |
| AAUCUCGGCUCACUGCAAGC | 713 |
| CAAUCUCGGCUCACUGCAAG | 714 |
| ACAAUCUCGGCUCACUGCAA | 715 |
| CACAAUCUCGGCUCACUGCA | 716 |
| GCACAAUCUCGGCUCACUGC | 717 |

TABLE 2-continued

| Sequence | SEQ ID NO: |
|---|---|
| GGCACAAUCUCGGCUCACUG | 718 |
| UGGCACAAUCUCGGCUCACU | 719 |
| GUGGCACAAUCUCGGCUCAC | 720 |
| AGUGGCACAAUCUCGGCUCA | 721 |
| CAGUGGCACAAUCUCGGCUC | 722 |
| GCAGUGGCACAAUCUCGGCU | 723 |
| UGCAGUGGCACAAUCUCGGC | 724 |
| AGGCUGAGUCUCGCUCUGUC | 725 |
| CCACAUUUUCUCACUGUCUU | 726 |
| CUCCUGACCACAUUUUCUCA | 727 |
| CCUCCUGACCACAUUUUCUC | 728 |
| CCCUCCUGACCACAUUUUCU | 729 |
| GCCCUCCUGACCACAUUUUC | 730 |
| UCUUGGUUCCCAGCUCAGC | 731 |
| GCAGUCUUGGUUCCCAGUCU | 732 |
| CAGCAGUCUUGGUUCCCAGU | 733 |
| UACAGCAGUCUUGGUUCCCA | 734 |
| AUACAGCAGUCUUGGUUCCC | 735 |
| CAAAUACAGCAGUCUUGGUU | 736 |
| GCAAAUACAGCAGUCUUGGU | 737 |
| GGCAAAUACAGCAGUCUUGG | 738 |
| AAGGCAAAUACAGCAGUCUU | 739 |
| CAAGGCAAAUACAGCAGUCU | 740 |
| GCAAGGCAAAUACAGCAGUC | 741 |
| AGCAAGGCAAAUACAGCAGU | 742 |
| AAAGCAAGGCAAAUACAGCA | 743 |
| CAAAGCAAGGCAAAUACAGC | 744 |
| UUGCAACAAAGCAAGGCAA | 745 |
| CUCUAAGAGCUUUUGACAAC | 746 |
| UUGCCUCAGCCUCCUAAAGU | 747 |
| CUUGCCUCAGCCUCCUAAAG | 748 |
| ACUUGCCUCAGCCUCCUAAA | 749 |
| CACUUGCCUCAGCCUCCUAA | 750 |
| CCACUUGCCUCAGCCUCCUA | 751 |
| UCCACUUGCCUCAGCCUCCU | 752 |
| AUCCACUUGCCUCAGCCUCC | 753 |
| UGGGCUCAAGCAAUCCACUU | 754 |
| CUGGGCUCAAGCAAUCCACU | 755 |

TABLE 2-continued

| Sequence | SEQ ID NO: |
|---|---|
| CCUGGGCUCAAGCAAUCCAC | 756 |
| UCCUGGGCUCAAGCAAUCCA | 757 |
| CUCCUGGGCUCAAGCAAUCC | 758 |
| ACUCCUGGGCUCAAGCAAUC | 759 |
| AACUCCUGGGCUCAAGCAAU | 760 |
| GAACUCCUGGGCUCAAGCAA | 761 |
| UGAACUCCUGGGCUCAAGCA | 762 |
| GUCUUGAACUCCUGGGCUCA | 763 |
| GGUCUUGAACUCCUGGGCUC | 764 |
| UGGUCUUGAACUCCUGGGCU | 765 |
| CUGGUCUUGAACUCCUGGGC | 766 |
| GCUGGUCUUGAACUCCUGGG | 767 |
| GGCUGGUCUUGAACUCCUGG | 768 |
| AGGCUGGUCUUGAACUCCUG | 769 |
| CAGGCUGGUCUUGAACUCCU | 770 |
| CCAGGCUGGUCUUGAACUCC | 771 |
| AUUUCCCACAGAGACAGGGU | 772 |
| CACCACACCUGGCUAAUUUU | 773 |
| CCACCACACCUGGCUAAUUU | 774 |
| ACCACCACACCUGGCUAAUU | 775 |
| CACCACCACACCUGGCUAAU | 776 |
| GCACCACCACACCUGGCUAA | 777 |
| AGUUGGGACUACAGGUGCGC | 778 |
| CUGCCUCAGCCUCCUUAGUA | 779 |
| UCUGCCUCAGCCUCCUUAGU | 780 |
| UUCUGCCUCAGCCUCCUUAG | 781 |
| CUUCUGCCUCAGCCUCCUUA | 782 |
| CCUUCUGCCUCAGCCUCCUU | 783 |
| UCCUUCUGCCUCAGCCUCCU | 784 |
| AUCCUUCUGCCUCAGCCUCC | 785 |
| AAUCCUUCUGCCUCAGCCUC | 786 |
| CAAUCCUUCUGCCUCAGCCU | 787 |
| CACAAUCAUAGCUCACUGCA | 788 |
| GCACAAUCAUAGCUCACUGC | 789 |
| CUCAAUCUGUUGUUCAGGCU | 790 |
| UCUCAAUCUGUUGUUCAGGC | 791 |
| GUCUCAAUCUGUUGUUCAGG | 792 |
| GGUCUCAAUCUGUUGUUCAG | 793 |
| CCUAGAAGUAGUGCCAGGCC | 794 |

TABLE 2-continued

| Sequence | SEQ ID NO: |
|---|---|
| UCCUAGAAGUAGUGCCAGGC | 795 |
| AUCCUAGAAGUAGUGCCAGG | 796 |
| GCAUCCUAGAAGUAGUGCCA | 797 |
| GACUGUGAGAGUUGCCUAAA | 798 |
| GGGACUGUGAGAGUUGCCUA | 799 |
| AGGGACUGUGAGAGUUGCCU | 800 |
| AAGGGACUGUGAGAGUUGCC | 801 |
| CAAGGGACUGUGAGAGUUGC | 802 |
| UCAAGGGACUGUGAGAGUUVG | 803 |
| UUCAAGGGACUGUGAGAGUU | 804 |
| CUUUCAAGGGACUGUGAGAG | 805 |
| UCUUUCAAGGGACUGUGAGA | 806 |
| CUCUUUCAAGGGACUGUGAG | 807 |
| UCUCUUUCAAGGGACUGUGA | 808 |
| CUUCUCUUUCAAGGGACUGU | 809 |
| ACUUCUCUUUCAAGGGACUG | 810 |
| CACUUCUCUUUCAAGGGACU | 811 |
| UGCCACUUCUCUUUCAAGGG | 812 |
| ACUUGGGAGGGCCUAUACCC | 813 |
| CACUUGGGAGGGCCUAUACC | 814 |
| ACACUUGGGAGGGCCUAUAC | 815 |
| CAUGACACUUGGGAGGGCCU | 816 |
| UCUUACACAGGGCAGAGUCC | 817 |
| AUCUUACACAGGGCAGAGUC | 818 |
| AAUCUUACACAGGGCAGAGU | 819 |
| AUGCAAUCUUACACAGGGCA | 820 |
| GUGAUGCAAUCUUACACAGG | 821 |
| GGUGAUGCAAUCUUACACAG | 822 |
| UGGUGAUGCAAUCUUACACA | 823 |
| GUGGUGAUGCAAUCUUACAC | 824 |
| GGUGGUGAUGCAAUCUUACA | 825 |
| UGGUGGUGAUGCAAUCUUAC | 826 |
| UGGUGGUGAUGCAAUCU | 827 |
| GUGGUGGUGGUGAUGCAAUC | 828 |
| GUGGUGGUGGUGGUGAUVGCA | 829 |
| AGGUGGUGGUGGUGGUGAUVG | 830 |
| GAGGUGGUGGUGGUGGUGAU | 831 |
| AGAGGUGGUGGUGGUGGUGA | 832 |
| AGAGAGGUGGUGGUGGUGGU | 833 |
| ACGUGUUCCUGUGAUGUCUG | 834 |
| AACGUGUUCCUGUGAUGUCU | 835 |
| GAACGUGUUCCUGUGAUGUC | 836 |
| UGAUGUGGAGGAGGGCCAGA | 837 |
| AUGAUGUGGAGGAGGGCCAG | 838 |
| CAUGAUGUGGAGGAGGGCCA | 839 |
| GGAGCAUGAUGUGGAGGAGG | 840 |
| UGGAGCAUGAUGUGGAGGAG | 841 |
| GUGGAGCAUGAUGUGGAGGA | 842 |
| UGUGGAGCAUGAUGUGGAGG | 843 |
| AUGUGGAGCAUGAUGUGGAG | 844 |
| GAUGUGGAGCAUGAUGUGGA | 845 |
| UGAUGUGGAGCAUGAUGUGG | 846 |
| AUGAUGUGGAGCAUGAUGUG | 847 |
| UGGAGCAUGAUGUGGAGCAU | 848 |
| GCCUGGAGCAUGAUGUGGAG | 849 |
| GGCCUGGAGCAUGAUGUGGA | 850 |
| UGGCCUGGAGCAUGAUGUGG | 851 |
| UUGGCCUGGAGCAUGAUGUG | 852 |
| GUUGGCCUGGAGCAUGAUGU | 853 |
| AGUUGGCCUGGAGCAUGAUG | 854 |
| CAGUUGGCCUGGAGCAUGAU | 855 |
| GCCACGAGGCACAGAAGUCA | 856 |
| GAGAAUGGAGCCCUCUUGCU | 857 |
| GGUAGGAGAAUGGAGCCCUC | 858 |
| GGGUAGGAGAAUGGAGCCCU | 859 |
| ACAGGGAUGAGGGUUUGGGC | 860 |
| UAGGACAGGGAUGAGGGUUU | 861 |
| CUAGGACAGGGAUGAGGGUU | 862 |
| UUCCAGUGGGUAUUCCUCUG | 863 |
| GUUCCAGUGGGUAUUCCUCU | 864 |
| AGUUCCAGUGGGUAUUCCUC | 865 |
| GCAGUUUCCAUGAGGCAGCU | 866 |
| UGCAGCAGUUUCCAUGAGGC | 867 |
| CUAGCUUCACCACUGCUGCA | 868 |
| CUUUCUAGCUUCACCACUGC | 869 |
| UAGUCUUUCUAGCUUCACCA | 870 |
| CUCAUACCUCUAGUCUUUCU | 871 |

TABLE 2-continued

| Sequence | SEQ ID NO: |
|---|---|
| CCUCAUACCUCUAGUCUUUC | 872 |
| CCCUCAUACCUCUAGUCUUU | 873 |
| UCCCUCAUACCUCUAGUCUU | 874 |
| UUCCCUCAUACCUCUAGUCU | 875 |
| UUUCCCUCAUACCUCUAGUC | 876 |
| UUUUCCCUCAUACCUCUAGU | 877 |
| AUUUUCCCUCAUACCUCUAG | 878 |
| GCAAUUUUCCCUCAUACCUC | 879 |
| ACGCCUUAUGAGCCAGGUGG | 880 |
| AACGCCUUAUGAGCCAGGUG | 881 |
| GAACGCCUUAUGAGCCAGGU | 882 |
| GGGAACGCCUUAUGAGCCAG | 883 |
| AGGGAACGCCUUAUGAGCCA | 884 |
| GAGGGAACGCCUUAUGAGCC | 885 |
| GGAGGGAACGCCUUAUGAGC | 886 |
| GGGAGGGAACGCCUUAUGAG | 887 |
| GAUGAUUUCACAUGCUCAGU | 888 |
| AGGAUGAUUUCACAUGCUCA | 889 |
| GAGGAUGAUUUCACAUGCUC | 890 |
| AGAGGAUGAUUUCACAUGCU | 891 |
| CAUGAUGCAAGAAAGAGGAU | 892 |
| GCAUGAUGCAAGAAAGAGGA | 893 |
| CACGCAUGAUGCAAGAAAGA | 894 |
| ACACGCAUGAUGCAAGAAAG | 895 |
| GACACGCAUGAUGCAAGAAA | 896 |
| GGACACGCAUGAUGCAAGAA | 897 |
| UGGACACGCAUGAUGCAAGA | 898 |
| GUGGACACGCAUGAUGCAAG | 899 |
| UGUGGACACGCAUGAUGCAA | 900 |
| AUGUGGACACGCAUGAUGCA | 901 |
| CAAUGUGGACACGCAUGAUG | 902 |
| GCAAUGUGGACACGCAUGAU | 903 |
| GUGCAAUGUGGACACGCAUG | 904 |
| GGUGCAAUGUGGACACGCAU | 905 |
| GGGUGCAAUGUGGACACGCA | 906 |
| UGACUGGGCCUGAAGUAGGG | 907 |
| CAUGGUGACUGGGCCUGAAG | 908 |
| CUCAGGUUUCACCAUCUGGC | 909 |

TABLE 2-continued

| Sequence | SEQ ID NO: |
|---|---|
| CAGCUCAGGUUUCACCAUCU | 910 |
| UCAGCUCAGGUUUCACCAUC | 911 |
| AUCAGCUCAGGUUUCACCAU | 912 |
| CAUCAGCUCAGGUUUCACCA | 913 |
| UCUGAGUCCCAGGAUUGGCC | 914 |
| CCUCUGAGUCCCAGGAUUGG | 915 |
| CCCUCUGAGUCCCAGGAUUG | 916 |
| ACCCUCUGAGUCCCAGGAUU | 917 |
| UACCCUCUGAGUCCCAGGAU | 918 |
| CUACCCUCUGAGUCCCAGGA | 919 |
| AGCCGACCUACCCUCUGAGU | 920 |
| AACCUAGUGGUCAGCCAGCC | 921 |
| AAACCUAGUGGUCAGCCAGC | 922 |
| CCAAACCUAGUGGUCAGCCA | 923 |
| UCCAAACCUAGUGGUCAGCC | 924 |
| UUCCAAACCUAGUGGUCAGC | 925 |
| UCUUCCAAACCUAGUGGUCA | 926 |
| GUCUUCCAAACCUAGUGGUC | 927 |
| GGUCUUCCAAACCUAGUGGU | 928 |
| GGGUCUUCCAAACCUAGUGG | 929 |
| UGGGUCUUCCAAACCUAGUG | 930 |
| CUGGGUCUUCCAAACCUAGU | 931 |
| CCUGGGUCUUCCAAACCUAG | 932 |
| GCUGCCUGGGUCUUCCAAAC | 933 |
| GGGCCUCUUUAGAGCCAGCU | 934 |
| AUGUCUGGCUACUGACCUGG | 935 |
| UCAUGUCUGGCUACUGACCU | 936 |
| CUCAUGUCUGGCUACUGACC | 937 |
| GCUCAUGUCUGGCUACUGAC | 938 |
| AGCUCAUGUCUGGCUACUGA | 939 |
| CAGCUCAUGUCUGGCUACUG | 940 |
| ACAGCUCAUGUCUGGCUACU | 941 |
| UGACCCUCACAGCUCAUGUC | 942 |
| UUGACCCUCACAGCUCAUGU | 943 |
| UGCUUGACCCUCACAGCUCA | 944 |
| GUGCUUGACCCUCACAGCUC | 945 |
| UAGCUGUGCUUGACCCUCAC | 946 |
| AUAGCUGUGCUUGACCCUCA | 947 |
| GAUAGCUGUGCUUGACCCUC | 948 |

TABLE 2-continued

| Sequence | SEQ ID NO: |
|---|---|
| GGAUAGCUGUGCUUGACCCU | 949 |
| UGGAUAGCUGUGCUUGACCC | 950 |
| AUGGAUAGCUGUGCUUGACC | 951 |
| GAUGGAUAGCUGUGCUUGAC | 952 |
| UGAUGGAUAGCUGUGCUUGA | 953 |
| AUCUGAUGGAUAGCUGUGCU | 954 |
| CAUCUGAUGGAUAGCUGUGC | 955 |
| AUCAUCUGAUGGAUAGCUGU | 956 |
| GAUCAUCUGAUGGAUAGCUG | 957 |
| AGAUCAUCUGAUGGAUAGCU | 958 |
| UAGAUCAUCUGAUGGAUAGC | 959 |
| GUAGAUCAUCUGAUGGAUAG | 960 |
| GAAAGUAGAUCAUCUGAUGG | 961 |
| GCUGAAAGUAGAUCAUCUGA | 962 |
| AGGCUGAAAGUAGAUCAUCU | 963 |
| AAGGCUGAAAGUAGAUCAUC | 964 |
| GAAGGCUGAAAGUAGAUCAU | 965 |
| GGAAGGCUGAAAGUAGAUCA | 966 |
| AGGAAGGCUGAAAGUAGAUC | 967 |
| GUCUGGGACUCAGGAAGGCU | 968 |
| UAUUGUCUGGGACUCAGGAA | 969 |
| CUAUUGUCUGGGACUCAGGA | 970 |
| UCUAUUGUCUGGGACUCAGG | 971 |
| CUUCUAUUGUCUGGGACUCA | 972 |
| UCUUCUAUUGUCUGGGACUC | 973 |
| CACCUGUCUUCUAUUGUCUG | 974 |
| CCACCUGUCUUCUAUUGUCU | 975 |
| GCCACCUGUCUUCUAUUGUC | 976 |
| AGCCACCUGUCUUCUAUUGU | 977 |
| AUGAGGGCACAGUGACAGCA | 978 |
| CAAUGAGGGCACAGUGACAG | 979 |
| CCAAUGAGGGCACAGUGACA | 980 |
| CGUCUGUUGAGUCUGAUUGC | 981 |
| CCGUCUGUUGAGUCUGAUUG | 982 |
| UCCGUCUGUUGAGUCUGAUU | 983 |
| CUCCGUCUGUUGAGUCUGAU | 984 |
| GCUCCGUCUGUUGAGUCUGA | 985 |
| UGCUCCGUCUGUUGAGUCUG | 986 |

TABLE 2-continued

| Sequence | SEQ ID NO: |
|---|---|
| UUGCUCCGUCUGUUGAGUCU | 987 |
| AGUUGCUCCGUCUGUUGAGU | 988 |
| GCAGUUGCUCCGUCUGUUGA | 989 |
| GGCAGUUGCUCCGUCUGUUG | 990 |
| GAUGGCAGUUGCUCCGUCUG | 991 |
| GGAUGGCAGUUGCUCCGUCU | 992 |
| AGCCUCGGAUGGCAGUUGCU | 993 |
| AGGAGCCUCGGAUGGCAGUU | 994 |
| UUCAGGAGCCUCGGAUGGCA | 995 |
| UGGUUCAGGAGCCUCGGAUG | 996 |
| CUGGUUCAGGAGCCUCGGAU | 997 |
| CUGGUGAAUGGCCCUGGUUC | 998 |
| CCUGGUGAAUGGCCCUGGUU | 999 |
| UCCUGGUGAAUGGCCCUGGU | 1000 |
| UGGACAUCAGGGAGCCGCAU | 1001 |
| AGGAUUUGCUGCUUGGCUAG | 1002 |
| CAGGAUUUGCUGCUUGGCUA | 1003 |
| UCCAGGAUUUGCUGCUUGGC | 1004 |
| ACCCAUCCAGGAUUUGCUGC | 1005 |
| AACCCAUCCAGGAUUUGCUG | 1006 |
| CAACCCAUCCAGGAUUUGCU | 1007 |
| UGCAACCCAUCCAGGAUUUG | 1008 |
| GUGCAACCCAUCCAGGAUUU | 1009 |
| GGUGCAACCCAUCCAGGAUU | 1010 |
| AGGUGCAACCCAUCCAGGAU | 1011 |
| CAGGUGCAACCCAUCCAGGA | 1012 |
| UCAGGUGCAACCCAUCCAGG | 1013 |
| GUCAGGUGCAACCCAUCCAG | 1014 |
| GGUCAGGUGCAACCCAUCCA | 1015 |
| UGGUCAGGUGCAACCCAUCC | 1016 |
| CUGGUCAGGUGCAACCCAUC | 1017 |
| ACUGGUCAGGUGCAACCCAU | 1018 |
| GACUGGUCAGGUGCAACCCA | 1019 |
| ACGACUGGUCAGGUGCAACC | 1020 |
| GACGACUGGUCAGGUGCAAC | 1021 |
| GGACGACUGGUCAGGUGCAA | 1022 |
| UCUGGGACGACUGGUCAGGU | 1023 |
| UUCUGGGACGACUGGUCAGG | 1024 |
| AUUCUGGGACGACUGGUCAG | 1025 |

TABLE 2-continued

| Sequence | SEQ ID NO: |
| --- | --- |
| UAUUCUGGGACGACUGGUCA | 1026 |
| UUAUUCUGGGACGACUGGUC | 1027 |
| GUUAUUCUGGGACGACUGGU | 1028 |
| AGUUAUUCUGGGACGACUGG | 1029 |
| GAGUUAUUCUGGGACGACUG | 1030 |
| UGAGUUAUUCUGGGACGACU | 1031 |
| AUGAGUUAUUCUGGGACGAC | 1032 |
| GAUGAGUUAUUCUGGGACGA | 1033 |
| GGAUGAGUUAUUCUGGGACG | 1034 |
| UGGAGGAUGAGUUAUUCUGG | 1035 |
| GUGGAGGAUGAGUUAUUCUG | 1036 |
| GGUGGAGGAUGAGUUAUUCU | 1037 |
| GGGUGGAGGAUGAGUUAUUC | 1038 |
| AAAGCUGAUGACCUCCUCCC | 1039 |
| CAAAGCUGAUGACCUCCUCC | 1040 |
| AGCAAAGCUGAUGACCUCCU | 1041 |
| UAGCAAAGCUGAUGACCUCC | 1042 |
| GUAGCAAAGCUGAUGACCUC | 1043 |
| AGUAGCAAAGCUGAUGACCU | 1044 |
| ACAGUAGCAAAGCUGAUGAC | 1045 |
| UGACAGUAGCAAAGCUGAUG | 1046 |
| GUGACAGUAGCAAAGCUGAU | 1047 |
| ACCUGUGACAGUAGCAAAGC | 1048 |
| CACCUGUGACAGUAGCAAAG | 1049 |
| CCACCUGUGACAGUAGCAAA | 1050 |
| CCCACCUGUGACAGUAGCAA | 1051 |
| ACCCACCUGUGACAGUAGCA | 1052 |
| CACCCACCUGUGACAGUAGC | 1053 |
| GUUGCUCUCUCCCUCACCCA | 1054 |
| CCUGUUGCUCUCUCCCUCAC | 1055 |
| GCCUGUUGCUCUCUCCCUCA | 1056 |
| UGCCUGUUGCUCUCUCCCUC | 1057 |
| CCCUGUCUGCUCUUUGCCUG | 1058 |
| UUUCCCUGUCUGCUCUUUGC | 1059 |
| UCCUCUGCAACCAGUCCCUG | 1060 |
| GUCCUCUGCAACCAGUCCCU | 1061 |
| GUGUCCUCUGCAACCAGUCC | 1062 |
| UGUGUCCUCUGCAACCAGUC | 1063 |

TABLE 2-continued

| Sequence | SEQ ID NO: |
| --- | --- |
| UUGUGUCCUCUGCAACCAGU | 1064 |
| ACUGCUUUGUGUCCUCUGCA | 1065 |
| GACUGCUUUGUGUCCUCUGC | 1066 |
| GAGACUGCUUUGUGUCCUCU | 1067 |
| AGAGACUGCUUUGUGUCCUC | 1068 |
| UAGAGACUGCUUUGUGUCCU | 1069 |
| UCCCUCGAACCUACCUCUAG | 1070 |
| CUCCCUCGAACCUACCUCUA | 1071 |
| UCUCCCUCGAACCUACCUCU | 1072 |
| CUCUCCCUCGAACCUACCUC | 1073 |
| ACUGCUCUCCCUCGAACCUA | 1074 |
| AGAUGAAGCUCUCCUCUGAG | 1075 |
| AUGUGAGUAGAGAUGAAGCU | 1076 |
| UGCCCGAAAGACAGAAAAGG | 1077 |
| CUGCCCGAAAGACAGAAAAG | 1078 |
| AGUGGAGUCUGCCCGAAAGA | 1079 |
| AAGUGGAGUCUGCCCGAAAG | 1080 |
| GAAGUGGAGUCUGCCCGAAA | 1081 |
| AGGCUGAAGUGGAGUCUGCC | 1082 |
| UAGGCUGAAGUGGAGUCUGC | 1083 |
| GUAGGCUGAAGUGGAGUCUG | 1084 |
| GCUGUAGGCUGAAGUGGAGU | 1085 |
| AGCUGUAGGCUGAAGUGGAG | 1086 |
| GAGCUGUAGGCUGAAGUGGA | 1087 |
| GGGAGCUGUAGGCUGAAGUG | 1088 |
| AGGGAGCUGUAGGCUGAAGU | 1089 |
| AAGUGAGCAGGGAGCUGUAG | 1090 |
| UGGACAGGUGAAAAGUGAGC | 1091 |
| GUGGACAGGUGAAAAGUGAG | 1092 |
| AGUGGACAGGUGAAAAGUGA | 1093 |
| GAGUGGACAGGUGAAAAGUG | 1094 |
| GGAGUGGACAGGUGAAAAGU | 1095 |
| AGGAGUGGACAGGUGAAAAG | 1096 |
| GAGGAGUGGACAGGUGAAAA | 1097 |
| CGAGGAGUGGACAGGUGAAA | 1098 |
| CCGAGGAGUGGACAGGUGAA | 1099 |
| ACCGAGGAGUGGACAGGUGA | 1100 |
| CAUGGUACAGGUGGUGGGAC | 1101 |
| GCAUGGUACAGGUGGUGGGA | 1102 |

TABLE 2-continued

| Sequence | SEQ ID NO: |
|---|---|
| CAAAGAGUGCCAGGAAGGGU | 1103 |
| GCAAAGAGUGCCAGGAAGGG | 1104 |
| AAGCAAAGAGUGCCAGGAAG | 1105 |
| UCAAGCAAAGAGUGCCAGGA | 1106 |
| CUCAAGCAAAGAGUGCCAGG | 1107 |
| CCUCAAGCAAAGAGUGCCAG | 1108 |
| AUCCUCAAGCAAAGAGUGCC | 1109 |
| GAUCCUCAAGCAAAGAGUGC | 1110 |
| GAAGAUCCUCAAGCAAAGAG | 1111 |
| GGAAGAUCCUCAAGCAAAGA | 1112 |
| CGGAAGAUCCUCAAGCAAAG | 1113 |
| AUCGGAAGAUCCUCAAGCAA | 1114 |
| CAUCGGAAGAUCCUCAAGCA | 1115 |
| CCAUCGGAAGAUCCUCAAGC | 1116 |
| CCCAUCGGAAGAUCCUCAAG | 1117 |
| AUGUGGUGCUCAGCCAGGAG | 1118 |
| UUGGUGAUGUGGUGCUCAGC | 1119 |
| GGUUGGUGAUGUGGUGCUCA | 1120 |
| AGGUUGGUGAUGUGGUGCUC | 1121 |
| CAGGUUGGUGAUGUGGUGCU | 1122 |
| AGCCCAGGUUGGUGAUGUGG | 1123 |
| CAGCCCAGGUUGGUGAUGUG | 1124 |
| UGCCAGCCCAGGUUGGUGAU | 1125 |
| AUGCCAGCCCAGGUUGGUGA | 1126 |
| GUAUGCCAGCCCAGGUUGGU | 1127 |
| AGGUAUGCCAGCCCAGGUUG | 1128 |
| AAGGUAUGCCAGCCCAGGUU | 1129 |
| UAAGGUAUGCCAGCCCAGGU | 1130 |
| UUAAGGUAUGCCAGCCCAGG | 1131 |
| GUUAAGGUAUGCCAGCCCAG | 1132 |
| AGUUAAGGUAUGCCAGCCCA | 1133 |
| GAGUUAAGGUAUGCCAGCCC | 1134 |
| AGAGUUAAGGUAUGCCAGCC | 1135 |
| CAGAGUUAAGGUAUGCCAGC | 1136 |
| GCAGAGUUAAGGUAUGCCAG | 1137 |
| AGGGCAGAGUUAAGGUAUGC | 1138 |
| AGAGGGCAGAGUUAAGGUAU | 1139 |
| UAGAGGGCAGAGUUAAGGUA | 1140 |
| CUAGAGGGCAGAGUUAAGGU | 1141 |
| CACUAGAGGGCAGAGUUAAG | 1142 |
| GCCACUAGAGGGCAGAGUUA | 1143 |
| GGACACCAGACUUCUCACCC | 1144 |
| AGGACACCAGACUUCUCACC | 1145 |
| CAGGACACCAGACUUCUCAC | 1146 |
| UUUCAGGACACCAGACUUCU | 1147 |
| GUUUCAGGACACCAGACUUC | 1148 |
| UAGUUGCAGUUUCAGGACAC | 1149 |
| CUAGUUGCAGUUUCAGGACA | 1150 |
| UCUAGUUGCAGUUUCAGGAC | 1151 |
| GUCUAGUUGCAGUUUCAGGA | 1152 |
| AGUCUAGUUGCAGUUUCAGG | 1153 |
| CAGUCUAGUUGCAGUUUCAG | 1154 |
| AACUGUGCUGUUGCCUUCUA | 1155 |
| UAACUGUGCUGUUGCCUUCU | 1156 |
| GUAACUGUGCUGUUGCCUUC | 1157 |
| CCAGUAACUGUGCUGUUGCC | 1158 |
| GUCCAGUAACUGUGCUGUUG | 1159 |
| UGUCCAGUAACUGUGCUGUU | 1160 |
| UUGUCCAGUAACUGUGCUGU | 1161 |
| GGUUGUCCAGUAACUGUGCU | 1162 |
| CGGUUGUCCAGUAACUGUGC | 1163 |
| UCGGUUGUCCAGUAACUGUG | 1164 |
| CUCGGUUGUCCAGUAACUGU | 1165 |
| CCUCGGUUGUCCAGUAACUG | 1166 |
| GCCUCGGUUGUCCAGUAACU | 1167 |
| CGCCUCGGUUGUCCAGUAAC | 1168 |
| CCGCCUCGGUUGUCCAGUAA | 1169 |
| UGCUGGUGUCCUGCUGUGUC | 1170 |
| CUGCUGGUGUCCUGCUGUGU | 1171 |
| UCUAGGAAGGGCUGCUGGUG | 1172 |
| UUAAGCUCUAGGAAGGGCUG | 1173 |
| CUCAUUGGCUCGGAUCUUAA | 1174 |
| GCUCAUUGGCUCGGAUCUUA | 1175 |
| GGCUCAUUGGCUCGGAUCUU | 1176 |
| AGGCUCAUUGGCUCGGAUCU | 1177 |
| CAGGCUCAUUGGCUCGGAUC | 1178 |
| UCCAGGCUCAUUGGCUCGGA | 1179 |

TABLE 2-continued

| Sequence | SEQ ID NO: |
| --- | --- |
| UCUCGCCUGCAACAUAAGGG | 1180 |
| CAGAAUGGAAAGAGGCAGCA | 1181 |
| GCAGAAUGGAAAGAGGCAGC | 1182 |
| AAGACGGCAGAAUGGAAAGA | 1183 |
| GAAGACGGCAGAAUGGAAAG | 1184 |
| UGAAGACGGCAGAAUGGAAA | 1185 |
| CUGAAGACGGCAGAAUGGAA | 1186 |
| GCUGAAGACGGCAGAAUGGA | 1187 |
| GGCUGAAGACGGCAGAAUGG | 1188 |
| AGGCUGAAGACGGCAGAAUG | 1189 |
| GGAGGCUGAAGACGGCAGAA | 1190 |
| AGGAGGCUGAAGACGGCAGA | 1191 |
| UGUUGGCUUUGAGGAGGCUG | 1192 |
| CAAGGAUUGUUGGCUUUGAG | 1193 |
| UGGCAGGCCAAGGAUUGUUG | 1194 |
| CUGGCAGGCCAAGGAUUGUU | 1195 |
| ACUGGCAGGCCAAGGAUUGU | 1196 |
| AGGAGGUACUGGCAGGCCAA | 1197 |
| AACAGGAGGUACUGGCAGGC | 1198 |
| CAACAGGAGGUACUGGCAGG | 1199 |
| ACACAACAGGAGGUACUGGC | 1200 |
| AGGGACACAACAGGAGGUAC | 1201 |
| UCGGGCAGUAGGGACACAAC | 1202 |
| UUCGGGCAGUAGGGACACAA | 1203 |
| CUUCGGGCAGUAGGGACACA | 1204 |
| AUGAUCCAGGUAGAGGAGAG | 1205 |
| UAUGAUCCAGGUAGAGGAGA | 1206 |
| UUAUGAUCCAGGUAGAGGAG | 1207 |
| AUUAUGAUCCAGGUAGAGGA | 1208 |
| CAUUAUGAUCCAGGUAGAGG | 1209 |
| CCAUUAUGAUCCAGGUAGAG | 1210 |
| UGCCAUUAUGAUCCAGGUAG | 1211 |
| UUGCCAUUAUGAUCCAGGUA | 1212 |
| AUUGCCAUUAUGAUCCAGGU | 1213 |
| CAUUGCCAUUAUGAUCCAGG | 1214 |
| ACAUUGCCAUUAUGAUCCAG | 1215 |
| CCACAUUGCCAUUAUGAUCC | 1216 |
| GACCACAUUGCCAUUAUGAU | 1217 |
| UGACCACAUUGCCAUUAUGA | 1218 |
| UUGACCACAUUGCCAUUAUG | 1219 |
| UCUUGACCACAUUGCCAUUA | 1220 |
| GUCUUGACCACAUUGCCAUU | 1221 |
| CGUCUUGACCACAUUGCCAU | 1222 |
| CCGUCUUGACCACAUUGCCA | 1223 |
| UCCGUCUUGACCACAUUGCC | 1224 |
| AUCCGUCUUGACCACAUUGC | 1225 |
| CAUCCGUCUUGACCACAUUG | 1226 |
| ACAUCCGUCUUGACCACAUU | 1227 |
| CACAUCCGUCUUGACCACAU | 1228 |
| GCACAUCCGUCUUGACCACA | 1229 |
| GGCACAUCCGUCUUGACCAC | 1230 |
| UGGCACAUCCGUCUUGACCA | 1231 |
| CUGGCACAUCCGUCUUGACC | 1232 |
| UCUGGCACAUCCGUCUUGAC | 1233 |
| AUCUGGCACAUCCGUCUUGA | 1234 |
| UAUCUGGCACAUCCGUCUUG | 1235 |
| AUAUCUGGCACAUCCGUCUU | 1236 |
| CAUAUCUGGCACAUCCGUCU | 1237 |
| CCAUAUCUGGCACAUCCGUC | 1238 |
| CACCAUAUCUGGCACAUCCG | 1239 |
| CUCCACCACCAUAUCUGGCA | 1240 |
| UGGUCUCUUCACUCCAAAGC | 1241 |
| CUUCAUCUUGGUCUCUUCAC | 1242 |
| ACUUCAUCUUGGUCUCUUCA | 1243 |
| AACUUCAUCUUGGUCUCUUC | 1244 |
| GGAAACUUCAUCUUGGUCUC | 1245 |
| CCUCCAGUCACAGAUGCCCU | 1246 |
| GAUGCCUCCAGUCACAGAUG | 1247 |
| UGAUGCCUCCAGUCACAGAU | 1248 |
| CAGGUGGUUGUUGGGUUGGG | 1249 |
| CCAGGUGGUUGUUGGGUUGG | 1250 |
| GCCAGGUGGUUGUUGGGUUG | 1251 |
| UGCCAGGUGGUUGUUGGGUU | 1252 |
| CAUAUUGCCAGGUGGUUGUU | 1253 |
| UCAUAUUGCCAGGUGGUUGU | 1254 |
| GUCAUAUUGCCAGGUGGUUG | 1255 |
| AGUCAUAUUGCCAGGUGGUU | 1256 |

TABLE 2-continued

| Sequence | SEQ ID NO: |
|---|---|
| GAGUCAUAUUGCCAGGUGGU | 1257 |
| AGUGAGUCAUAUUGCCAGGU | 1258 |
| AAGUGAGUCAUAUUGCCAGG | 1259 |
| CAAGUGAGUCAUAUUGCCAG | 1260 |
| GUCAAGUGAGUCAUAUUGCC | 1261 |
| GGUCAAGUGAGUCAUAUUGC | 1262 |
| GGGUCAAGUGAGUCAUAUUG | 1263 |
| CCCAUUUGGGUCCCAUAGGG | 1264 |
| GCCCAUUUGGGUCCCAUAGG | 1265 |
| UGCCCAUUUGGGUCCCAUAG | 1266 |
| GUGCCCAUUUGGGUCCCAUA | 1267 |
| AGUGCCCAUUUGGGUCCCAU | 1268 |
| AAGUGCCCAUUUGGGUCCCA | 1269 |
| AAAGUGCCCAUUUGGGUCCC | 1270 |
| GAAAGUGCCCAUUUGGGUCC | 1271 |
| AGAAAGUGCCCAUUUGGGUC | 1272 |
| CAAGAAAGUGCCCAUUUGGG | 1273 |
| ACAAGAAAGUGCCCAUUUGG | 1274 |
| GACAAGAAAGUGCCCAUUUG | 1275 |
| GAGUCUCAGACAAGAAAGUG | 1276 |
| CCAGAGUCUCAGACAAGAAA | 1277 |
| GCCAGAGUCUCAGACAAGAA | 1278 |
| AGCCAGAGUCUCAGACAAGA | 1279 |
| UAAGCCAGAGUCUCAGACAA | 1280 |
| AUAAGCCAGAGUCUCAGACA | 1281 |
| AGCCAACCUGGAAUAAGCCA | 1282 |
| UCAGCCAACCUGGAAUAAGC | 1283 |
| CAUCAGCCAACCUGGAAUAA | 1284 |
| CACAUCAGCCAACCUGGAAU | 1285 |
| ACACAUCAGCCAACCUGGAA | 1286 |
| AACACAUCAGCCAACCUGGA | 1287 |
| CAACACAUCAGCCAACCUGG | 1288 |
| CUCCCAACACAUCAGCCAAC | 1289 |
| CGCUUUACCCAUCUCCCAAC | 1290 |
| AACGCUUUACCCAUCUCCCA | 1291 |
| AAACGCUUUACCCAUCUCCC | 1292 |
| AGAAACGCUUUACCCAUCUC | 1293 |
| AAGAAACGCUUUACCCAUCU | 1294 |
| GAAGAAACGCUUUACCCAUC | 1295 |
| AGAAGAAACGCUUUACCCAU | 1296 |
| UAGAAGAAACGCUUUACCCA | 1297 |
| UUAGAAGAAACGCUUUACCC | 1298 |
| AAUCAUGCUUUCUGGGUAGA | 1299 |
| CUUAGGGCAGGAAAUCAUGC | 1300 |
| ACUUAGGGCAGGAAAUCAUG | 1301 |
| GACUUAGGGCAGGAAAUCAU | 1302 |
| AGGACUUAGGGCAGGAAAUC | 1303 |
| CAGGACUUAGGGCAGGAAAU | 1304 |
| ACAGGACUUAGGGCAGGAAA | 1305 |
| UCUCACAGGACUUAGGGCAG | 1306 |
| UUCUCACAGGACUUAGGGCA | 1307 |
| AUCUUCUCACAGGACUUAGG | 1308 |
| CAUCUUCUCACAGGACUUAG | 1309 |
| UAGUCCCUGACAUCUUCUCA | 1310 |
| CUAGUCCCUGACAUCUUCUC | 1311 |
| CCUAGUCCCUGACAUCUUCU | 1312 |
| CCCUAGUCCCUGACAUCUUC | 1313 |
| UCCCUAGUCCCUGACAUCUU | 1314 |
| CUCCCUAGUCCCUGACAUCU | 1315 |
| AUCUAUCUGCUUCCUCCUCC | 1316 |
| CCAUCUAUCUGCUUCCUCCU | 1317 |
| ACCAUCUAUCUGCUUCCUCC | 1318 |
| GACCAUCUAUCUGCUUCCUC | 1319 |
| GGACCAUCUAUCUGCUUCCU | 1320 |
| UGGACCAUCUAUCUGCUUCC | 1321 |
| CUGGACCAUCUAUCUGCUUC | 1322 |
| CUGCUGGACCAUCUAUCUGC | 1323 |
| GCCUGCUGGACCAUCUAUCU | 1324 |
| UUCAAGCCUGCUGGACCAUC | 1325 |
| UGCUUCAAGCCUGCUGGACC | 1326 |
| CCUCAACAGCCCUUACCCUG | 1327 |
| UCCCUCUUGACCUUCCCUUA | 1328 |
| CUCCCUCUUGACCUUCCCUU | 1329 |
| UCUCCCUCUUGACCUUCCCU | 1330 |
| CAUCUCCCUCUUGACCUUCC | 1331 |
| CCAUCUCCCUCUUGACCUUC | 1332 |
| CCCAUCUCCCUCUUGACCUU | 1333 |

TABLE 2-continued

| Sequence | SEQ ID NO: |
|---|---|
| GCCCAUCUCCCUCUUGACCU | 1334 |
| UUGCCCAUCUCCCUCUUGAC | 1335 |
| CUUGCCCAUCUCCCUCUUGA | 1336 |
| CCCUAAGCAUCCUCCCUCAG | 1337 |
| AACUUCUUAGGCUUAGUGCC | 1338 |
| GGAACUUCUUAGGCUUAGUG | 1339 |
| GGGAACUUCUUAGGCUUAGU | 1340 |
| AGGGAACUUCUUAGGCUUAG | 1341 |
| UGUCUCCCAGUGGGUCCUGU | 1342 |
| AGUAUAAAUGCUUGUCUCCC | 1343 |
| GACAGAGCGAGACUCGAUCU | 1344 |
| UGACAGAGCGAGACUCGAUC | 1345 |
| GUGACAGAGCGAGACUCGAU | 1346 |
| GGUGACAGAGCGAGACUCGA | 1347 |
| UGGUGACAGAGCGAGACUCG | 1348 |
| CUGGUGACAGAGCGAGACUC | 1349 |
| CCUGGUGACAGAGCGAGACU | 1350 |
| AGCCUGGUGACAGAGCGAGA | 1351 |
| UGCACUCCAGCCUGGUGACA | 1352 |
| ACUGCACUCCAGCCUGGUGA | 1353 |
| UCACUGCACUCCAGCCUGGU | 1354 |
| UGUCACUGCACUCCAGCCUG | 1355 |
| GUGUCACUGCACUCCAGCCU | 1356 |
| AGACGGAGGUUGCAGUGAGC | 1357 |
| GAGACGGAGGUUGCAGUGAG | 1358 |
| GGAGACGGAGGUUGCAGUGA | 1359 |
| ACUUGAACCCAGGAGACGGA | 1360 |
| CACUUGAACCCAGGAGACGG | 1361 |
| UCACUUGAACCCAGGAGACG | 1362 |
| AUCACUUGAACCCAGGAGAC | 1363 |
| AAUCACUUGAACCCAGGAGA | 1364 |
| GAAUCACUUGAACCCAGGAG | 1365 |
| AGAAUCACUUGAACCCAGGA | 1366 |
| AAGAAUCACUUGAACCCAGG | 1367 |
| GAAGAAUCACUUGAACCCAG | 1368 |
| AGAAGAAUCACUUGAACCCA | 1369 |
| CAGAAGAAUCACUUGAACCC | 1370 |
| GCAGAAGAAUCACUUGAACC | 1371 |
| GGCAGAAGAAUCACUUGAAC | 1372 |
| AGGCAGAAGAAUCACUUGAA | 1373 |
| GAGGCAGAAGAAUCACUUGA | 1374 |
| UGAGGCAGAAGAAUCACUUG | 1375 |
| CUGAGGCAGAAGAAUCACUU | 1376 |
| GCUGAGGCAGAAGAAUCACU | 1377 |
| GGCUGAGGCAGAAGAAUCAC | 1378 |
| AGGCUGAGGCAGAAGAAUCA | 1379 |
| GAGGCUGAGGCAGAAGAAUC | 1380 |
| GGAGGCUGAGGCAGAAGAAU | 1381 |
| GGGAGGCUGAGGCAGAAGAA | 1382 |
| AGAUUGAGACCAUCCUGGCC | 1383 |
| GAGAUUGAGACCAUCCUGGC | 1384 |
| AGAGAUUGAGACCAUCCUGG | 1385 |
| AAGAGAUUGAGACCAUCCUG | 1386 |
| CAAGAGAUUGAGACCAUCCU | 1387 |
| GGUGGCUCACGCCAUAAUC | 1388 |
| CGGUGGCUCACGCCAUAAU | 1389 |
| GCGGUGGCUCACGCCAUAA | 1390 |
| CCCUAACCCUUCUUUAUGAC | 1391 |
| CACCCUAACCCUUCUUUAUG | 1392 |
| AUCACCCUAACCCUUCUUUA | 1393 |
| CAUCACCCUAACCCUUCUUU | 1394 |
| CCAUCACCCUAACCCUUCUU | 1395 |
| GACCAUCACCCUAACCCUUC | 1396 |
| GGACCAUCACCCUAACCCUU | 1397 |
| UGGACCAUCACCCUAACCCU | 1398 |
| CUGGACCAUCACCCUAACCC | 1399 |
| UCUGGACCAUCACCCUAACC | 1400 |
| CUCUGGACCAUCACCCUAAC | 1401 |
| GCUCUGGACCAUCACCCUAA | 1402 |
| UGCUCUGGACCAUCACCCUA | 1403 |
| GUUGCUCUGGACCAUCACCC | 1404 |
| UGUUGCUCUGGACCAUCACC | 1405 |
| ACUGUUGCUCUGGACCAUCA | 1406 |
| AACUGUUGCUCUGGACCAUC | 1407 |
| GAACUGUUGCUCUGGACCAU | 1408 |
| GAAGAACUGUUGCUCUGGAC | 1409 |
| UUGAAGAACUGUUGCUCUGG | 1410 |

TABLE 2-continued

| Sequence | SEQ ID NO: |
|---|---|
| ACUUGAAGAACUGUUGCUCU | 1411 |
| CACUUGAAGAACUGUUGCUC | 1412 |
| UACACUUGAAGAACUGUUGC | 1413 |
| GAGUACACUUGAAGAACUGU | 1414 |
| AGAGUACACUUGAAGAACUG | 1415 |
| CAGAGUACACUUGAAGAACU | 1416 |
| ACAGAGUACACUUGAAGAAC | 1417 |
| CUACAGAGUACACUUGAAGA | 1418 |
| CCUACAGAGUACACUUGAAG | 1419 |
| GCCUACAGAGUACACUUGAA | 1420 |
| AGCCUACAGAGUACACUUGA | 1421 |
| AAGCCUACAGAGUACACUUG | 1422 |
| CAGAAGCCUACAGAGUACAC | 1423 |
| CCAGAAGCCUACAGAGUACA | 1424 |
| AAAAGGGACCUCCCAGAAGC | 1425 |
| GAAAAGGGACCUCCCAGAAG | 1426 |
| UGAAAAGGGACCUCCCAGAA | 1427 |
| CUUUGACUUUGUGGACACCC | 1428 |
| GCUUUGACUUUGUGGACACC | 1429 |
| UAGCUUUGACUUUGUGGACA | 1430 |
| AUAGCUUUGACUUUGUGGAC | 1431 |
| GUCACACGGCCUCUGGAAAA | 1432 |
| UGUCACACGGCCUCUGGAAA | 1433 |
| AUGUCACACGGCCUCUGGAA | 1434 |
| AAGACCAUACAAGCACACAU | 1435 |
| ACAAGACCAUACAAGCACAC | 1436 |
| CACAAGACCAUACAAGCACA | 1437 |
| AACACAAGACCAUACAAGCA | 1438 |
| UAACACAAGACCAUACAAGC | 1439 |
| ACUGUAACACAAGACCAUAC | 1440 |
| AGACUGUAACACAAGACCAU | 1441 |
| AAGACUGUAACACAAGACCA | 1442 |
| GCCGAGAUUGUGCCACUGCA | 1443 |
| AGCCGAGAUUGUGCCACUGC | 1444 |
| GAGCCGAGAUUGUGCCACUG | 1445 |
| UGAGCCGAGAUUGUGCCACU | 1446 |
| GUGAGCCGAGAUUGUGCCAC | 1447 |
| AGUGAGCCGAGAUUGUGCCA | 1448 |

TABLE 2-continued

| Sequence | SEQ ID NO: |
|---|---|
| CAGUGAGCCGAGAUUGUGCC | 1449 |
| GCAGUGAGCCGAGAUUGUGC | 1450 |
| UGCAGUGAGCCGAGAUUGUG | 1451 |
| UUGCAGUGAGCCGAGAUUGU | 1452 |
| GUUGCAGUGAGCCGAGAUUG | 1453 |
| GGUUGCAGUGAGCCGAGAUU | 1454 |
| AGGUUGCAGUGAGCCGAGAU | 1455 |
| GAGGUUGCAGUGAGCCGAGA | 1456 |
| UGGAGGUUGCAGUGAGCCGA | 1457 |
| AGGUGGAGGUUGCAGUGAGC | 1458 |
| GAGGUGGAGGUUGCAGUGAG | 1459 |
| GGAGGUGGAGGUUGCAGUGA | 1460 |
| UGGGAGGUGGAGGUUGCAGU | 1461 |
| UCCCAGCUACUCAGGAGGCU | 1462 |
| AGUCCCAGCUACUCAGGAGG | 1463 |
| UAGUCCCAGCUACUCAGGAG | 1464 |
| AAAUAGCUGGGCAUGGUGGC | 1465 |
| AAAAUAGCUGGGCAUGGUGG | 1466 |
| GCAGGCGGAUCACCUCAAGU | 1467 |
| AGGCAGGCGGAUCACCUCAA | 1468 |
| AAGGCAGGCGGAUCACCUCA | 1469 |
| CUGUAAUCCCAGCACUUUGG | 1470 |
| CCUGUAAUCCCAGCACUUUG | 1471 |
| ACCUGUAAUCCCAGCACUUU | 1472 |
| GACCUGUAAUCCCAGCACUU | 1473 |
| AGACCUGUAAUCCCAGCACU | 1474 |
| CAGACCUGUAAUCCCAGCAC | 1475 |
| UCAGACCUGUAAUCCCAGCA | 1476 |
| CUCAGACCUGUAAUCCCAGC | 1477 |
| AGGCACAGUGGCUCAGACCU | 1478 |
| UAGGCACAGUGGCUCAGACC | 1479 |
| UUAGGCACAGUGGCUCAGAC | 1480 |
| GUUAGGCACAGUGGCUCAGA | 1481 |
| GGUUAGGCACAGUGGCUCAG | 1482 |
| AGGUUAGGCACAGUGGCUCA | 1483 |
| AUUAGGUUAGGCACAGUGGC | 1484 |
| GUCAUUAGGUUAGGCACAGU | 1485 |
| AGUCAUUAGGUUAGGCACAG | 1486 |
| AAGUCAUUAGGUUAGGCACA | 1487 |

TABLE 2-continued

| Sequence | SEQ ID NO: |
|---|---|
| AAAGUCAUUAGGUUAGGCAC | 1488 |
| GAACACCUUACUUUCUUCUC | 1489 |
| AGCUCUCUUAGAACACCUUA | 1490 |
| GGUGCCCAGCAAGAAGAGCU | 1491 |
| GGUUUAAGCGGUCUUCCGGC | 1492 |
| GGGUUUAAGCGGUCUUCCGG | 1493 |
| UGGGUUUAAGCGGUCUUCCG | 1494 |
| CUGGGUUUAAGCGGUCUUCC | 1495 |
| CAUAGCCUCGAACUCCUGGG | 1496 |
| UCAUAGCCUCGAACUCCUGG | 1497 |
| AUCAUAGCCUCGAACUCCUG | 1498 |
| GAUCAUAGCCUCGAACUCCU | 1499 |
| GCAGAGGCUAUUCACAAGUG | 1500 |
| UGCAGAGGCUAUUCACAAGU | 1501 |
| GUGCAGAGGCUAUUCACAAG | 1502 |
| AGUGCAGAGGCUAUUCACAA | 1503 |
| AGGCUGGAGUGCAGAGGCUA | 1504 |
| UUUGCCCAGGCUGGAGUGCA | 1505 |
| AUUUGCCCAGGCUGGAGUGC | 1506 |
| UAUUUGCCCAGGCUGGAGUG | 1507 |
| CUAUUUGCCCAGGCUGGAGU | 1508 |
| ACUAUUUGCCCAGGCUGGAG | 1509 |
| CCAGAGGAGCUAUUUAUGUA | 1510 |
| AGACUAAUGGGCACUGAAAA | 1511 |
| GACCAGACUAAUGGGCACUG | 1512 |
| CAGACCAGACUAAUGGGCAC | 1513 |
| GUCAGACCAGACUAAUGGGC | 1514 |
| CCAGCUCAGUCAGACCAGAC | 1515 |
| CCCAGCUCAGUCAGACCAGA | 1516 |
| GACCCAGCUCAGUCAGACCA | 1517 |
| AGACCCAGCUCAGUCAGACC | 1518 |
| AGAGACCCAGCUCAGUCAGA | 1519 |
| UCAGAGACCCAGCUCAGUCA | 1520 |
| UGACCCAGGCUAGUUAUCCC | 1521 |
| UUGACCCAGGCUAGUUAUCC | 1522 |
| UUUGACCCAGGCUAGUUAUC | 1523 |
| CUUUGACCCAGGCUAGUUAU | 1524 |
| ACUUUGACCCAGGCUAGUUA | 1525 |

TABLE 2-continued

| Sequence | SEQ ID NO: |
|---|---|
| GACUUUGACCCAGGCUAGUU | 1526 |
| GGACUUUGACCCAGGCUAGU | 1527 |
| UUCAGUCUGAGGGUCAAGGG | 1528 |
| GUUCAGUCUGAGGGUCAAGG | 1529 |
| UGUUCAGUCUGAGGGUCAAG | 1530 |
| CUGUUCAGUCUGAGGGUCAA | 1531 |
| ACUGUUCAGUCUGAGGGUCA | 1532 |
| AACUGUUCAGUCUGAGGGUC | 1533 |
| UAACUGUUCAGUCUGAGGGU | 1534 |
| UUAACUGUUCAGUCUGAGGG | 1535 |
| GUGGAAGGUCAGUGGGUUAA | 1536 |
| GUGUGGAAGGUCAGUGGGUU | 1537 |
| GGUGUGGAAGGUCAGUGGGU | 1538 |
| UGGGUGUGGAAGGUCAGUGG | 1539 |
| UUGGGUGUGGAAGGUCAGUG | 1540 |
| UCUGCUUCCAAGAACCACCC | 1541 |
| GCUCUGCUUCCAAGAACCAC | 1542 |
| AGCUCUGCUUCCAAGAACCA | 1543 |
| UAGCUCUGCUUCCAAGAACC | 1544 |
| CCUAGCUCUGCUUCCAAGAA | 1545 |
| ACAUCCUAGCUCUGCUUCCA | 1546 |
| ACCUCCCACAUCCUAGCUCU | 1547 |
| GACCUCCCACAUCCUAGCUC | 1548 |
| AGACCUCCCACAUCCUAGCU | 1549 |
| CAGACCUCCCACAUCCUAGC | 1550 |
| GCAGACCUCCCACAUCCUAG | 1551 |
| GGCAGACCUCCCACAUCCUA | 1552 |
| AGGCAGACCUCCCACAUCCU | 1553 |
| ACAGGCAGACCUCCCACAUC | 1554 |
| CACAGGCAGACCUCCCACAU | 1555 |
| GGAGGAAGCAUGACAAGGAA | 1556 |
| AAGAGGAGGAAGCAUGACAA | 1557 |
| GGGCAGCAUUUCAGUCUCUG | 1558 |
| GAUUUGCAUUGCCAUCGUGA | 1559 |
| AGAUUUGCAUUGCCAUCGUG | 1560 |
| CUCUUUAGAUUUGCAUUGCC | 1561 |
| CCUCUUUAGAUUUGCAUUGC | 1562 |
| GCCUCUUUAGAUUUGCAUUG | 1563 |
| AAGUGCCCUGCCUCUUUAGA | 1564 |

TABLE 2-continued

| Sequence | SEQ ID NO: |
| --- | --- |
| GAAGUGCCCUGCCUCUUUAG | 1565 |
| GGGAAGUGCCCUGCCUCUUU | 1566 |
| ACUGCCUGACAGGGAAGUGC | 1567 |
| GUACUGCCUGACAGGGAAGU | 1568 |
| GGUACUGCCUGACAGGGAAG | 1569 |
| CGGUACUGCCUGACAGGGAA | 1570 |
| UAUGCCCAGCGGUACUGCCU | 1571 |
| UGCUAUGCCCAGCGGUACUG | 1572 |
| UUGCUAUGCCCAGCGGUACU | 1573 |
| GUUGCUAUGCCCAGCGGUAC | 1574 |
| GGUUGCUAUGCCCAGCGGUA | 1575 |
| AGGUUGCUAUGCCCAGCGGU | 1576 |
| AGAGGUUGCUAUGCCCAGCG | 1577 |
| AGAGGCAGAGGUUGCUAUGC | 1578 |
| GAGAGGCAGAGGUUGCUAUG | 1579 |
| GGAGAGGCAGAGGUUGCUAU | 1580 |
| CGGAGAGGCAGAGGUUGCUA | 1581 |
| AACGGAGAGGCAGAGGUUGC | 1582 |
| GAGAAACGGAGAGGCAGAGG | 1583 |
| UGAGAAACGGAGAGGCAGAG | 1584 |
| UCUGAGAAACGGAGAGGCAG | 1585 |
| AGGAGGUGGAUAUGUGAGCU | 1586 |
| CCCAGGAGGUGGAUAUGUGA | 1587 |
| AGCCCAGGAGGUGGAUAUGU | 1588 |
| AAGCCCAGGAGGUGGAUAUG | 1589 |
| AAAGCCCAGGAGGUGGAUAU | 1590 |
| AAAAGCCCAGGAGGUGGAUA | 1591 |
| UAAAAGCCCAGGAGGUGGAU | 1592 |
| UUAAAAGCCCAGGAGGUGGA | 1593 |
| GCCCACUUAAAAGCCCAGGA | 1594 |
| AGCCCACUUAAAAGCCCAGG | 1595 |
| AAGCCCACUUAAAAGCCCAG | 1596 |
| AAAGCCCACUUAAAAGCCCA | 1597 |
| UAAAGCCCACUUAAAAGCCC | 1598 |
| CUAAAGCCCACUUAAAAGCC | 1599 |
| CACUAAAGCCCACUUAAAAG | 1600 |
| CCUCACUAAAGCCCACUUAA | 1601 |
| CCCUCACUAAAGCCCACUUA | 1602 |

TABLE 2-continued

| Sequence | SEQ ID NO: |
| --- | --- |
| GGAGCCCAGUUGAAGGAGGA | 1603 |
| AGGAGCCCAGUUGAAGGAGG | 1604 |
| GGAGGAGCCCAGUUGAAGGA | 1605 |
| AGGAGGAGCCCAGUUGAAGG | 1606 |
| AGUCGAAGCAGAAGAGCUGG | 1607 |
| GAGUCGAAGCAGAAGAGCUG | 1608 |
| GGAGUCGAAGCAGAAGAGCU | 1609 |
| CGGAGUCGAAGCAGAAGAGC | 1610 |
| UCGGAGUCGAAGCAGAAGAG | 1611 |
| CUCGGAGUCGAAGCAGAAGA | 1612 |
| GCUCGGAGUCGAAGCAGAAG | 1613 |
| CGCUCGGAGUCGAAGCAGAA | 1614 |
| ACAUGACACCCGCUCGGAGU | 1615 |
| ACACAUGACACCCGCUCGGA | 1616 |
| UCACACAUGACACCCGCUCG | 1617 |
| CUCACACAUGACACCCGCUC | 1618 |
| UCUCACACAUGACACCCGCU | 1619 |
| UUCUCACACAUGACACCCGC | 1620 |
| GUACUGCCUGACAGGGAAGU | 1568 |
| GGUACUGCCUGACAGGGAAG | 1569 |
| CGGUACUGCCUGACAGGGAA | 1570 |
| UAUGCCCAGCGGUACUGCCU | 1571 |
| UGCUAUGCCCAGCGGUACUG | 1572 |
| UUGCUAUGCCCAGCGGUACU | 1573 |
| GUUGCUAUGCCCAGCGGUAC | 1574 |
| GGUUGCUAUGCCCAGCGGUA | 1575 |
| AGGUUGCUAUGCCCAGCGGU | 1576 |
| AGAGGUUGCUAUGCCCAGCG | 1577 |
| AGAGGCAGAGGUUGCUAUGC | 1578 |
| GAGAGGCAGAGGUUGCUAUG | 1579 |
| GGAGAGGCAGAGGUUGCUAU | 1580 |
| CGGAGAGGCAGAGGUUGCUA | 1581 |
| AACGGAGAGGCAGAGGUUGC | 1582 |
| GAGAAACGGAGAGGCAGAGG | 1583 |
| UGAGAAACGGAGAGGCAGAG | 1584 |
| UCUGAGAAACGGAGAGGCAG | 1585 |
| AGGAGGUGGAUAUGUGAGCU | 1586 |
| CCCAGGAGGUGGAUAUGUGA | 1587 |
| AGCCCAGGAGGUGGAUAUGU | 1588 |

TABLE 2-continued

| Sequence | SEQ ID NO: |
|---|---|
| AAGCCCAGGAGGUGGAUAUG | 1589 |
| AAAGCCCAGGAGGUGGAUAU | 1590 |
| AAAAGCCCAGGAGGUGGAUA | 1591 |
| UAAAAGCCCAGGAGGUGGAU | 1592 |
| UUAAAAGCCCAGGAGGUGGA | 1593 |
| GCCCACUUAAAAGCCCAGGA | 1594 |
| AGCCCACUUAAAAGCCCAGG | 1595 |
| AAGCCCACUUAAAAGCCCAG | 1596 |
| AAAGCCCACUUAAAAGCCCA | 1597 |
| UAAAGCCCACUUAAAAGCCC | 1598 |
| CUAAAGCCCACUUAAAAGCC | 1599 |
| CACUAAAGCCCACUUAAAAG | 1600 |
| CCUCACUAAAGCCCACUUAA | 1601 |
| CCCUCACUAAAGCCCACUUA | 1602 |
| GGAGCCCAGUUGAAGGAGGA | 1603 |
| AGGAGCCCAGUUGAAGGAGG | 1604 |
| GGAGGAGCCCAGUUGAAGGA | 1605 |
| AGGAGGAGCCCAGUUGAAGG | 1606 |
| AGUCGAAGCAGAAGAGCUGG | 1607 |
| GAGUCGAAGCAGAAGAGCUG | 1608 |
| GGAGUCGAAGCAGAAGAGCU | 1609 |
| CGGAGUCGAAGCAGAAGAGC | 1610 |
| GUUCUCACACAUGACACCCG | 1621 |
| CGUUCUCACACAUGACACCC | 1622 |
| UGGCCGUUCUCACACAUGAC | 1623 |
| CUGGCCGUUCUCACACAUGA | 1624 |
| GCUGGCCGUUCUCACACAUG | 1625 |
| UGCUGGCCGUUCUCACACAU | 1626 |
| CUGCUGGCCGUUCUCACACA | 1627 |
| UCUGCUGGCCGUUCUCACAC | 1628 |
| CUCUGCUGGCCGUUCUCACA | 1629 |

In some embodiments, the siRNA molecules comprise or consist of the nucleotide sequences (sense and antisense strands) shown in Table 3.

TABLE 3

| Sense Sequence | SEQ ID NO: | Antisense Sequence | SEQ ID NO: |
|---|---|---|---|
| GUAGCCAGACAUGAGCUGU | 1630 | ACAGCUCAUGUCUGGCUAC | 1631 |
| AGACAUGAGCUGUGAGGGU | 1632 | ACCCUCACAGCUCAUGUCU | 1633 |
| AUGAGCUGUGAGGGUCAAG | 1634 | CUUGACCCUCACAGCUCAU | 1635 |
| UGAGCUGUGAGGGUCAAGC | 1636 | GCUUGACCCUCACAGCUCA | 1637 |
| GAGCUGUGAGGGUCAAGCA | 1638 | UGCUUGACCCUCACAGCUC | 1639 |
| AGCUGUGAGGGUCAAGCAC | 1640 | GUGCUUGACCCUCACAGCU | 1641 |
| GUGAGGGUCAAGCACAGCU | 1642 | AGCUGUGCUUGACCCUCAC | 1643 |
| UGAGGGUCAAGCACAGCUA | 1644 | UAGCUGUGCUUGACCCUCA | 1645 |
| GAGGGUCAAGCACAGCUAU | 1646 | AUAGCUGUGCUUGACCCUC | 1647 |
| AGGGUCAAGCACAGCUAUC | 1648 | GAUAGCUGUGCUUGACCCU | 1649 |
| GGGUCAAGCACAGCUAUCC | 1650 | GGAUAGCUGUGCUUGACCC | 1651 |
| CAAGCACAGCUAUCCAUCA | 1652 | UGAUGGAUAGCUGUGCUUG | 1653 |
| CACAGCUAUCCAUCAGAUG | 1654 | CAUCUGAUGGAUAGCUGUG | 1655 |
| ACAGCUAUCCAUCAGAUGA | 1656 | UCAUCUGAUGGAUAGCUGU | 1657 |
| CAGCUAUCCAUCAGAUGAU | 1658 | AUCAUCUGAUGGAUAGCUG | 1659 |
| AGCUAUCCAUCAGAUGAUC | 1660 | GAUCAUCUGAUGGAUAGCU | 1661 |
| GCUAUCCAUCAGAUGAUCU | 1662 | AGAUCAUCUGAUGGAUAGC | 1663 |
| CUAUCCAUCAGAUGAUCUA | 1664 | UAGAUCAUCUGAUGGAUAG | 1665 |
| CAUCAGAUGAUCUACUUUC | 1666 | GAAAGUAGAUCAUCUGAUG | 1667 |
| AGAUGAUCUACUUUCAGCC | 1668 | GGCUGAAAGUAGAUCAUCU | 1669 |
| GAUCUACUUUCAGCCUUCC | 1670 | GGAAGGCUGAAAGUAGAUC | 1671 |
| AUCUACUUUCAGCCUUCCU | 1672 | AGGAAGGCUGAAAGUAGAU | 1673 |
| CAAUAGAAGACAGGUGGCU | 1674 | AGCCACCUGUCUUCUAUUG | 1675 |
| AAUAGAAGACAGGUGGCUG | 1676 | CAGCCACCUGUCUUCUAUU | 1677 |
| CAGGUGGCUGUACCCUUGG | 1678 | CCAAGGGUACAGCCACCUG | 1679 |
| AGGUGGCUGUACCCUUGGC | 1680 | GCCAAGGGUACAGCCACCU | 1681 |
| GGCUGUACCCUUGGCCAAG | 1682 | CUUGGCCAAGGGUACAGCC | 1683 |
| UGGUGUCUGCUGUCACUGU | 1684 | ACAGUGACAGCAGACACCA | 1685 |
| GUCUGCUGUCACUGUGCCC | 1686 | GGGCACAGUGACAGCAGAC | 1687 |
| CUGCUGUCACUGUGCCCUC | 1688 | GAGGGCACAGUGACAGCAG | 1689 |
| UGCUGUCACUGUGCCCUCA | 1690 | UGAGGGCACAGUGACAGCA | 1691 |
| GCUGUCACUGUGCCCUCAU | 1692 | AUGAGGGCACAGUGACAGC | 1693 |
| CUGUCACUGUGCCCUCAUU | 1694 | AAUGAGGGCACAGUGACAG | 1695 |
| UGUCACUGUGCCCUCAUUG | 1696 | CAAUGAGGGCACAGUGACA | 1697 |
| GUCACUGUGCCCUCAUUGG | 1698 | CCAAUGAGGGCACAGUGAC | 1699 |
| ACUGUGCCCUCAUUGGCCC | 1700 | GGGCCAAUGAGGGCACAGU | 1701 |
| CCCAGCAAUCAGACUCAAC | 1702 | GUUGAGUCUGAUUGCUGGG | 1703 |
| GGAGCAACUGCCAUCCGAG | 1704 | CUCGGAUGGCAGUUGCUCC | 1705 |

TABLE 3-continued

| Sense Sequence | SEQ ID NO: | Antisense Sequence | SEQ ID NO: |
|---|---|---|---|
| GAGCAACUGCCAUCCGAGG | 1706 | CCUCGGAUGGCAGUUGCUC | 1707 |
| AGCAACUGCCAUCCGAGGC | 1708 | GCCUCGGAUGGCAGUUGCU | 1709 |
| GCAACUGCCAUCCGAGGCU | 1710 | AGCCUCGGAUGGCAGUUGC | 1711 |
| CAACUGCCAUCCGAGGCUC | 1712 | GAGCCUCGGAUGGCAGUUG | 1713 |
| GCCAUCCGAGGCUCCUGAA | 1714 | UUCAGGAGCCUCGGAUGGC | 1715 |
| AACCAGGGCCAUUCACCAG | 1716 | CUGGUGAAUGGCCCUGGUU | 1717 |
| ACCAGGGCCAUUCACCAGG | 1718 | CCUGGUGAAUGGCCCUGGU | 1719 |
| CCAGGGCCAUUCACCAGGA | 1720 | UCCUGGUGAAUGGCCCUGG | 1721 |
| CAGGGCCAUUCACCAGGAG | 1722 | CUCCUGGUGAAUGGCCCUG | 1723 |
| GGCCAUUCACCAGGAGCAU | 1724 | AUGCUCCUGGUGAAUGGCC | 1725 |
| GCCAUUCACCAGGAGCAUG | 1726 | CAUGCUCCUGGUGAAUGGC | 1727 |
| CCAUUCACCAGGAGCAUGC | 1728 | GCAUGCUCCUGGUGAAUGG | 1729 |
| CAUUCACCAGGAGCAUGCG | 1730 | CGCAUGCUCCUGGUGAAUG | 1731 |
| AUUCACCAGGAGCAUGCGG | 1732 | CCGCAUGCUCCUGGUGAAU | 1733 |
| UUCACCAGGAGCAUGCGGC | 1734 | GCCGCAUGCUCCUGGUGAA | 1735 |
| UCACCAGGAGCAUGCGGCU | 1736 | AGCCGCAUGCUCCUGGUGA | 1737 |
| AGCAUGCGGCUCCCUGAUG | 1738 | CAUCAGGGAGCCGCAUGCU | 1739 |
| GCAUGCGGCUCCCUGAUGU | 1740 | ACAUCAGGGAGCCGCAUGC | 1741 |
| CAUGCGGCUCCCUGAUGUC | 1742 | GACAUCAGGGAGCCGCAUG | 1743 |
| AUGCGGCUCCCUGAUGUCC | 1744 | GGACAUCAGGGAGCCGCAU | 1745 |
| UGCGGCUCCCUGAUGUCCA | 1746 | UGGACAUCAGGGAGCCGCA | 1747 |
| GCUCCCUGAUGUCCAGCUC | 1748 | GAGCUGGACAUCAGGGAGC | 1749 |
| CUCCCUGAUGUCCAGCUCU | 1750 | AGAGCUGGACAUCAGGGAG | 1751 |
| UCCCUGAUGUCCAGCUCUG | 1752 | CAGAGCUGGACAUCAGGGA | 1753 |
| CCCUGAUGUCCAGCUCUGG | 1754 | CCAGAGCUGGACAUCAGGG | 1755 |
| CCUGAUGUCCAGCUCUGGC | 1756 | GCCAGAGCUGGACAUCAGG | 1757 |
| CUGAUGUCCAGCUCUGGCU | 1758 | AGCCAGAGCUGGACAUCAG | 1759 |
| UCUGGUGCUGGAGCUAGCC | 1760 | GGCUAGCUCCAGCACCAGA | 1761 |
| UGGUGCUGGAGCUAGCCAA | 1762 | UUGGCUAGCUCCAGCACCA | 1763 |
| GGUGCUGGAGCUAGCCAAG | 1764 | CUUGGCUAGCUCCAGCACC | 1765 |
| GUGCUGGAGCUAGCCAAGC | 1766 | GCUUGGCUAGCUCCAGCAC | 1767 |
| GCUGGAGCUAGCCAAGCAG | 1768 | CUGCUUGGCUAGCUCCAGC | 1769 |
| CUGGAGCUAGCCAAGCAGC | 1770 | GCUGCUUGGCUAGCUCCAG | 1771 |
| UGGAGCUAGCCAAGCAGCA | 1772 | UGCUGCUUGGCUAGCUCCA | 1773 |
| GGAGCUAGCCAAGCAGCAA | 1774 | UUGCUGCUUGGCUAGCUCC | 1775 |
| GAGCUAGCCAAGCAGCAAA | 1776 | UUUGCUGCUUGGCUAGCUC | 1777 |
| AGCUAGCCAAGCAGCAAAU | 1778 | AUUUGCUGCUUGGCUAGCU | 1779 |
| GCUAGCCAAGCAGCAAAUC | 1780 | GAUUUGCUGCUUGGCUAGC | 1781 |
| CAGCAAAUCCUGGAUGGGU | 1782 | ACCCAUCCAGGAUUUGCUG | 1783 |
| AGCAAAUCCUGGAUGGGUU | 1784 | AACCCAUCCAGGAUUUGCU | 1785 |
| GCAAAUCCUGGAUGGGUUG | 1786 | CAACCCAUCCAGGAUUUGC | 1787 |
| CAAAUCCUGGAUGGGUUGC | 1788 | GCAACCCAUCCAGGAUUUG | 1789 |
| AAAUCCUGGAUGGGUUGCA | 1790 | UGCAACCCAUCCAGGAUUU | 1791 |
| GGUUGCACCUGACCAGUCG | 1792 | CGACUGGUCAGGUGCAACC | 1793 |
| GUUGCACCUGACCAGUCGU | 1794 | ACGACUGGUCAGGUGCAAC | 1795 |
| UUGCACCUGACCAGUCGUC | 1796 | GACGACUGGUCAGGUGCAA | 1797 |
| UGCACCUGACCAGUCGUCC | 1798 | GGACGACUGGUCAGGUGCA | 1799 |
| UGACCAGUCGUCCCAGAAU | 1800 | AUUCUGGGACGACUGGUCA | 1801 |
| GACCAGUCGUCCCAGAAUA | 1802 | UAUUCUGGGACGACUGGUC | 1803 |
| ACCAGUCGUCCCAGAAUAA | 1804 | UUAUUCUGGGACGACUGGU | 1805 |
| CCAGUCGUCCCAGAAUAAC | 1806 | GUUAUUCUGGGACGACUGG | 1807 |
| CAGUCGUCCCAGAAUAACU | 1808 | AGUUAUUCUGGGACGACUG | 1809 |
| AGUCGUCCCAGAAUAACUC | 1810 | GAGUUAUUCUGGGACGACU | 1811 |
| GUCGUCCCAGAAUAACUCA | 1812 | UGAGUUAUUCUGGGACGAC | 1813 |
| UCGUCCCAGAAUAACUCAU | 1814 | AUGAGUUAUUCUGGGACGA | 1815 |
| CGUCCCAGAAUAACUCAUC | 1816 | GAUGAGUUAUUCUGGGACG | 1817 |
| GUCCCAGAAUAACUCAUCC | 1818 | GGAUGAGUUAUUCUGGGAC | 1819 |
| UCCCAGAAUAACUCAUCCU | 1820 | AGGAUGAGUUAUUCUGGGA | 1821 |
| CCCAGAAUAACUCAUCCUC | 1822 | GAGGAUGAGUUAUUCUGGG | 1823 |
| GACUACAGCCAGGGAGUGU | 1824 | ACACUCCCUGGCUGUAGUC | 1825 |
| ACUACAGCCAGGGAGUGUG | 1826 | CACACUCCCUGGCUGUAGU | 1827 |
| CUACAGCCAGGGAGUGUGG | 1828 | CCACACUCCCUGGCUGUAG | 1829 |
| GAGUGUGGCUCCAGGGAAU | 1830 | AUUCCCUGGAGCCACACUC | 1831 |
| GGGAGGAGGUCAUCAGCUU | 1832 | AAGCUGAUGACCUCCUCCC | 1833 |
| GAGGUCAUCAGCUUUGCUA | 1834 | UAGCAAAGCUGAUGACCUC | 1835 |
| AGGUCAUCAGCUUUGCUAC | 1836 | GUAGCAAAGCUGAUGACCU | 1837 |
| GGUCAUCAGCUUUGCUACU | 1838 | AGUAGCAAAGCUGAUGACC | 1839 |
| GCUUUGCUACUGUCACAGA | 1840 | UCUGUGACAGUAGCAAAGC | 1841 |
| CUUUGCUACUGUCACAGAC | 1842 | GUCUGUGACAGUAGCAAAG | 1843 |
| UUUGCUACUGUCACAGACU | 1844 | AGUCUGUGACAGUAGCAAA | 1845 |
| UUGCUACUGUCACAGACUC | 1846 | GAGUCUGUGACAGUAGCAA | 1847 |
| UGCUACUGUCACAGACUCC | 1848 | GGAGUCUGUGACAGUAGCA | 1849 |
| ACUGUCACAGACUCCACUU | 1850 | AAGUGGAGUCUGUGACAGU | 1851 |
| CUGUCACAGACUCCACUUC | 1852 | GAAGUGGAGUCUGUGACAG | 1853 |
| UGUCACAGACUCCACUUCA | 1854 | UGAAGUGGAGUCUGUGACA | 1855 |
| GUCACAGACUCCACUUCAG | 1856 | CUGAAGUGGAGUCUGUGAC | 1857 |

TABLE 3-continued

| Sense Sequence | SEQ ID NO: | Antisense Sequence | SEQ ID NO: |
|---|---|---|---|
| UCACAGACUCCACUUCAGC | 1858 | GCUGAAGUGGAGUCUGUGA | 1859 |
| CACAGACUCCACUUCAGCC | 1860 | GGCUGAAGUGGAGUCUGUG | 1861 |
| UCCACUUCAGCCUACAGCU | 1862 | AGCUGUAGGCUGAAGUGGA | 1863 |
| CCACUUCAGCCUACAGCUC | 1864 | GAGCUGUAGGCUGAAGUGG | 1865 |
| CACUUCAGCCUACAGCUCC | 1866 | GGAGCUGUAGGCUGAAGUG | 1867 |
| ACUUCAGCCUACAGCUCCC | 1868 | GGGAGCUGUAGGCUGAAGU | 1869 |
| CCUACAGCUCCCUGCUCAC | 1870 | GUGAGCAGGGAGCUGUAGG | 1871 |
| CUACAGCUCCCUGCUCACU | 1872 | AGUGAGCAGGGAGCUGUAG | 1873 |
| UACAGCUCCCUGCUCACUU | 1874 | AAGUGAGCAGGGAGCUGUA | 1875 |
| GCUCCCUGCUCACUUUUCA | 1876 | UGAAAAGUGAGCAGGGAG | 1877 |
| CUCCCUGCUCACUUUUCAC | 1878 | GUGAAAAGUGAGCAGGGAG | 1879 |
| GCUCACUUUUCACCUGUCC | 1880 | GGACAGGUGAAAAGUGAGC | 1881 |
| CUCACUUUUCACCUGUCCA | 1882 | UGGACAGGUGAAAAGUGAG | 1883 |
| UGUCCACUCCUCGGUCCCA | 1884 | UGGGACCGAGGAGUGGACA | 1885 |
| UCGGUCCCACCACCUGUAC | 1886 | GUACAGGUGGUGGGACCGA | 1887 |
| CCACCACCUGUACCAUGCC | 1888 | GGCAUGGUACAGGUGGUGG | 1889 |
| CACCACCUGUACCAUGCCC | 1890 | GGGCAUGGUACAGGUGGUG | 1891 |
| ACCACCUGUACCAUGCCCG | 1892 | CGGGCAUGGUACAGGUGGU | 1893 |
| CACCCUUCCUGGCACUCUU | 1894 | AAGAGUGCCAGGAAGGGUG | 1895 |
| ACCCUUCCUGGCACUCUUU | 1896 | AAAGAGUGCCAGGAAGGGU | 1897 |
| CCCUUCCUGGCACUCUUUG | 1898 | CAAAGAGUGCCAGGAAGGG | 1899 |
| CCUUCCUGGCACUCUUUGC | 1900 | GCAAAGAGUGCCAGGAAGG | 1901 |
| UUCCUGGCACUCUUUGCUU | 1902 | AAGCAAAGAGUGCCAGGAA | 1903 |
| UCCUGGCACUCUUUGCUUG | 1904 | CAAGCAAAGAGUGCCAGGA | 1905 |
| CCUGGCACUCUUUGCUUGA | 1906 | UCAAGCAAAGAGUGCCAGG | 1907 |
| CUGGCACUCUUUGCUUGAG | 1908 | CUCAAGCAAAGAGUGCCAG | 1909 |
| UGGCACUCUUUGCUUGAGG | 1910 | CCUCAAGCAAAGAGUGCCA | 1911 |
| GGCACUCUUUGCUUGAGGA | 1912 | UCCUCAAGCAAAGAGUGCC | 1913 |
| GCACUCUUUGCUUGAGGAU | 1914 | AUCCUCAAGCAAAGAGUGC | 1915 |
| CACUCUUUGCUUGAGGAUC | 1916 | GAUCCUCAAGCAAAGAGUG | 1917 |
| ACUCUUUGCUUGAGGAUCU | 1918 | AGAUCCUCAAGCAAAGAGU | 1919 |
| CUCUUUGCUUGAGGAUCUU | 1920 | AAGAUCCUCAAGCAAAGAG | 1921 |
| UCUUUGCUUGAGGAUCUUC | 1922 | GAAGAUCCUCAAGCAAAGA | 1923 |
| UGCUUGAGGAUCUUCCGAU | 1924 | AUCGGAAGAUCCUCAAGCA | 1925 |
| GCUUGAGGAUCUUCCGAUG | 1926 | CAUCGGAAGAUCCUCAAGC | 1927 |
| GCACUCUCCUGGCUGAGCA | 1928 | UGCUCAGCCAGGAGAGUGC | 1929 |
| CUCCUGGCUGAGCACCACA | 1930 | UGUGGUGCUCAGCCAGGAG | 1931 |
| UGGCUGAGCACCACAUCAC | 1932 | GUGAUGUGGUGCUCAGCCA | 1933 |
| GGCUGAGCACCACAUCACC | 1934 | GGUGAUGUGGUGCUCAGCC | 1935 |
| GCUGAGCACCACAUCACCA | 1936 | UGGUGAUGUGGUGCUCAGC | 1937 |
| CUGAGCACCACAUCACCAA | 1938 | UUGGUGAUGUGGUGCUCAG | 1939 |
| CCAACCUGGGCUGGCAUAC | 1940 | GUAUGCCAGCCCAGGUUGG | 1941 |
| CAACCUGGGCUGGCAUACC | 1942 | GGUAUGCCAGCCCAGGUUG | 1943 |
| AACCUGGGCUGGCAUACCU | 1944 | AGGUAUGCCAGCCCAGGUU | 1945 |
| ACCUGGGCUGGCAUACCUU | 1946 | AAGGUAUGCCAGCCCAGGU | 1947 |
| CCUGGGCUGGCAUACCUUA | 1948 | UAAGGUAUGCCAGCCCAGG | 1949 |
| CUGGGCUGGCAUACCUUAA | 1950 | UUAAGGUAUGCCAGCCCAG | 1951 |
| UGGGCUGGCAUACCUUAAC | 1952 | GUUAAGGUAUGCCAGCCCA | 1953 |
| GGGCUGGCAUACCUUAACU | 1954 | AGUUAAGGUAUGCCAGCCC | 1955 |
| GGCUGGCAUACCUUAACUC | 1956 | GAGUUAAGGUAUGCCAGCC | 1957 |
| GCUGGCAUACCUUAACUCU | 1958 | AGAGUUAAGGUAUGCCAGC | 1959 |
| CAUACCUUAACUCUGCCCU | 1960 | AGGGCAGAGUUAAGGUAUG | 1961 |
| AUACCUUAACUCUGCCCUC | 1962 | GAGGGCAGAGUUAAGGUAU | 1963 |
| UACCUUAACUCUGCCCUCU | 1964 | AGAGGGCAGAGUUAAGGUA | 1965 |
| UCUGCCCUCUAGUGGCUUG | 1966 | CAAGCCACUAGAGGGCAGA | 1967 |
| CUGCCCUCUAGUGGCUUGA | 1968 | UCAAGCCACUAGAGGGCAG | 1969 |
| UGCCCUCUAGUGGCUUGAG | 1970 | CUCAAGCCACUAGAGGGCA | 1971 |
| AGAAGUCUGGUGUCCUGAA | 1972 | UUCAGGACACCAGACUUCU | 1973 |
| CAGGACACCAGCAGCCCUU | 1974 | AAGGGCUGCUGGUGUCCUG | 1975 |
| AGGACACCAGCAGCCCUUC | 1976 | GAAGGGCUGCUGGUGUCCU | 1977 |
| ACACCAGCAGCCCUUCCUA | 1978 | UAGGAAGGGCUGCUGGUGU | 1979 |
| CACCAGCAGCCCUUCCUAG | 1980 | CUAGGAAGGGCUGCUGGUG | 1981 |
| ACCAGCAGCCCUUCCUAGA | 1982 | UCUAGGAAGGGCUGCUGGU | 1983 |
| CCAGCAGCCCUUCCUAGAG | 1984 | CUCUAGGAAGGGCUGCUGG | 1985 |
| CAGCAGCCCUUCCUAGAGC | 1986 | GCUCUAGGAAGGGCUGCUG | 1987 |
| AGCAGCCCUUCCUAGAGCU | 1988 | AGCUCUAGGAAGGGCUGCU | 1989 |
| GCCCUUCCUAGAGCUUAAG | 1990 | CUUAAGCUCUAGGAAGGGC | 1991 |
| CCCUUCCUAGAGCUUAAGA | 1992 | UCUUAAGCUCUAGGAAGGG | 1993 |
| AGCUUAAGAUCCGAGCCAA | 1994 | UUGGCUCGGAUCUUAAGCU | 1995 |
| GCUUAAGAUCCGAGCCAAU | 1996 | AUUGGCUCGGAUCUUAAGC | 1997 |
| CUUAAGAUCCGAGCCAAUG | 1998 | CAUUGGCUCGGAUCUUAAG | 1999 |
| UUAAGAUCCGAGCCAAUGA | 2000 | UCAUUGGCUCGGAUCUUAA | 2001 |
| UAAGAUCCGAGCCAAUGAG | 2002 | CUCAUUGGCUCGGAUCUUA | 2003 |
| CGAGCCAAUGAGCCUGGAG | 2004 | CUCCAGGCUCAUUGGCUCG | 2005 |
| CCCUUAUGUUCAGGCGAG | 2006 | CUCGCCUGCAACAUAAGGG | 2007 |
| CAUUACGUAGACUUCCAGG | 2008 | CCUGGAAGUCUACGUAAUG | 2009 |

TABLE 3-continued

| Sense Sequence | SEQ ID NO: | Antisense Sequence | SEQ ID NO: |
|---|---|---|---|
| AUUACGUAGACUUCCAGGA | 2010 | UCCUGGAAGUCUACGUAAU | 2011 |
| UUACGUAGACUUCCAGGAA | 2012 | UUCCUGGAAGUCUACGUAA | 2013 |
| ACUGGAUACUGCAGCCCGA | 2014 | UCGGGCUGCAGUAUCCAGU | 2015 |
| CUGGAUACUGCAGCCCGAG | 2016 | CUCGGGCUGCAGUAUCCAG | 2017 |
| UGGAUACUGCAGCCCGAGG | 2018 | CCUCGGGCUGCAGUAUCCA | 2019 |
| GGGUACCAGCUGAAUUACU | 2020 | AGUAAUUCAGCUGGUACCC | 2021 |
| CUGAAUUACUGCAGUGGGC | 2022 | GCCCACUGCAGUAAUUCAG | 2023 |
| UGAAUUACUGCAGUGGGCA | 2024 | UGCCCACUGCAGUAAUUCA | 2025 |
| UGGCAGCCCAGGCAUUGCU | 2026 | AGCAAUGCCUGGGCUGCCA | 2027 |
| GCAUUGCUGCCUCUUUCCA | 2028 | UGGAAAGAGGCAGCAAUGC | 2029 |
| CAUUGCUGCCUCUUUCCAU | 2030 | AUGGAAAGAGGCAGCAAUG | 2031 |
| AUUGCUGCCUCUUUCCAUU | 2032 | AAUGGAAAGAGGCAGCAAU | 2033 |
| UGCUGCCUCUUUCCAUUCU | 2034 | AGAAUGGAAAGAGGCAGCA | 2035 |
| GCUGCCUCUUUCCAUUCUG | 2036 | CAGAAUGGAAAGAGGCAGC | 2037 |
| CUGCCUCUUUCCAUUCUGC | 2038 | GCAGAAUGGAAAGAGGCAG | 2039 |
| UGCCUCUUUCCAUUCUGCC | 2040 | GGCAGAAUGGAAAGAGGCA | 2041 |
| GCCUCUUUCCAUUCUGCCG | 2042 | CGGCAGAAUGGAAAGAGGC | 2043 |
| CCUCUUUCCAUUCUGCCGU | 2044 | ACGGCAGAAUGGAAAGAGG | 2045 |
| CUCUUUCCAUUCUGCCGUC | 2046 | GACGGCAGAAUGGAAAGAG | 2047 |
| CAUUCUGCCGUCUUCAGCC | 2048 | GGCUGAAGACGGCAGAAUG | 2049 |
| CUUCAGCCUCCUCAAAGCC | 2050 | GGCUUUGAGGAGGCUGAAG | 2051 |
| UUCAGCCUCCUCAAAGCCA | 2052 | UGGCUUUGAGGAGGCUGAA | 2053 |
| UCAGCCUCCUCAAAGCCAA | 2054 | UUGGCUUUGAGGAGGCUGA | 2055 |
| CAGCCUCCUCAAAGCCAAC | 2056 | GUUGGCUUUGAGGAGGCUG | 2057 |
| UCCUUGGCCUGCCAGUACC | 2058 | GGUACUGGCAGGCCAAGGA | 2059 |
| CCUGCCAGUACCUCCUGUU | 2060 | AACAGGAGGUACUGGCAGG | 2061 |
| CUGCCAGUACCUCCUGUUG | 2062 | CAACAGGAGGUACUGGCAG | 2063 |
| UGCCAGUACCUCCUGUUGU | 2064 | ACAACAGGAGGUACUGGCA | 2065 |
| GCCAGUACCUCCUGUUGUG | 2066 | CACAACAGGAGGUACUGGC | 2067 |
| CCAGUACCUCCUGUUGUGU | 2068 | ACACAACAGGAGGUACUGG | 2069 |
| CAGUACCUCCUGUUGUGUC | 2070 | GACACAACAGGAGGUACUG | 2071 |
| GUACCUCCUGUUGUGUCCC | 2072 | GGGACACAACAGGAGGUAC | 2073 |
| UACCUCCUGUUGUGUCCCU | 2074 | AGGGACACAACAGGAGGUA | 2075 |
| ACCUCCUGUUGUGUCCCUA | 2076 | UAGGGACACAACAGGAGGU | 2077 |
| CCUCCUGUUGUGUCCCUAC | 2078 | GUAGGGACACAACAGGAGG | 2079 |
| CUCCUGUUGUGUCCCUACU | 2080 | AGUAGGGACACAACAGGAG | 2081 |
| UUGUGUCCCUACUGCCCGA | 2082 | UCGGGCAGUAGGGACACAA | 2083 |
| UGUGUCCCUACUGCCCGAA | 2084 | UUCGGGCAGUAGGGACACA | 2085 |
| GUGUCCCUACUGCCCGAAG | 2086 | CUUCGGGCAGUAGGGACAC | 2087 |
| UGUCCCUACUGCCCGAAGG | 2088 | CCUUCGGGCAGUAGGGACA | 2089 |
| UCUCUCUCCUCUACCUGGA | 2090 | UCCAGGUAGAGGAGAGAGA | 2091 |
| UCUCCUCUACCUGGAUCAU | 2092 | AUGAUCCAGGUAGAGGAGA | 2093 |
| CUCCUCUACCUGGAUCAUA | 2094 | UAUGAUCCAGGUAGAGGAG | 2095 |
| UCCUCUACCUGGAUCAUAA | 2096 | UUAUGAUCCAGGUAGAGGA | 2097 |
| CCUCUACCUGGAUCAUAAU | 2098 | AUUAUGAUCCAGGUAGAGG | 2099 |
| CUCUACCUGGAUCAUAAUG | 2100 | CAUUAUGAUCCAGGUAGAG | 2101 |
| UCUACCUGGAUCAUAAUGG | 2102 | CCAUUAUGAUCCAGGUAGA | 2103 |
| CUACCUGGAUCAUAAUGGC | 2104 | GCCAUUAUGAUCCAGGUAG | 2105 |
| UACCUGGAUCAUAAUGGCA | 2106 | UGCCAUUAUGAUCCAGGUA | 2107 |
| ACCUGGAUCAUAAUGGCAA | 2108 | UUGCCAUUAUGAUCCAGGU | 2109 |
| CCUGGAUCAUAAUGGCAAU | 2110 | AUUGCCAUUAUGAUCCAGG | 2111 |
| CUGGAUCAUAAUGGCAAUG | 2112 | CAUUGCCAUUAUGAUCCAG | 2113 |
| UGGAUCAUAAUGGCAAUGU | 2114 | ACAUUGCCAUUAUGAUCCA | 2115 |
| GGAUCAUAAUGGCAAUGUG | 2116 | CACAUUGCCAUUAUGAUCC | 2117 |
| GAUCAUAAUGGCAAUGUGG | 2118 | CCACAUUGCCAUUAUGAUC | 2119 |
| AUAAUGGCAAUGUGGUCAA | 2120 | UUGACCACAUUGCCAUUAU | 2121 |
| UAAUGGCAAUGUGGUCAAG | 2122 | CUUGACCACAUUGCCAUUA | 2123 |
| AAUGGCAAUGUGGUCAAGA | 2124 | UCUUGACCACAUUGCCAUU | 2125 |
| AAUGUGGUCAAGACGGAUG | 2126 | CAUCCGUCUUGACCACAUU | 2127 |
| AUGUGGUCAAGACGGAUGU | 2128 | ACAUCCGUCUUGACCACAU | 2129 |
| UGUGGUCAAGACGGAUGUG | 2130 | CACAUCCGUCUUGACCACA | 2131 |
| GUGGUCAAGACGGAUGUGC | 2132 | GCACAUCCGUCUUGACCAC | 2133 |
| UGGUCAAGACGGAUGUGCC | 2134 | GGCACAUCCGUCUUGACCA | 2135 |
| GGUCAAGACGGAUGUGCCA | 2136 | UGGCACAUCCGUCUUGACC | 2137 |
| GUCAAGACGGAUGUGCCAG | 2138 | CUGGCACAUCCGUCUUGAC | 2139 |
| UCAAGACGGAUGUGCCAGA | 2140 | UCUGGCACAUCCGUCUUGA | 2141 |
| CAAGACGGAUGUGCCAGAU | 2142 | AUCUGGCACAUCCGUCUUG | 2143 |
| AAGACGGAUGUGCCAGAUA | 2144 | UAUCUGGCACAUCCGUCUU | 2145 |
| AGACGGAUGUGCCAGAUAU | 2146 | AUAUCUGGCACAUCCGUCU | 2147 |
| GACGGAUGUGCCAGAUAUG | 2148 | CAUAUCUGGCACAUCCGUC | 2149 |
| ACGGAUGUGCCAGAUAUGG | 2150 | CCAUAUCUGGCACAUCCGU | 2151 |
| CGGAUGUGCCAGAUAUGGU | 2152 | ACCAUAUCUGGCACAUCCG | 2153 |
| GGAUGUGCCAGAUAUGGUG | 2154 | CACCAUAUCUGGCACAUCC | 2155 |
| GAUGUGCCAGAUAUGGUGG | 2156 | CCACCAUAUCUGGCACAUC | 2157 |
| GCCAGAUAUGGUGGUGGAG | 2158 | CUCCACCACCAUAUCUGGC | 2159 |
| CCAGAUAUGGUGGUGGAGG | 2160 | CCUCCACCACCAUAUCUGG | 2161 |

TABLE 3-continued

| Sense Sequence | SEQ ID NO: | Antisense Sequence | SEQ ID NO: |
|---|---|---|---|
| CAGAUAUGGUGGUGGAGGC | 2162 | GCCUCCACCACCAUAUCUG | 2163 |
| AGAUAUGGUGGUGGAGGCC | 2164 | GGCCUCCACCACCAUAUCU | 2165 |
| GAUAUGGUGGUGGAGGCCU | 2166 | AGGCCUCCACCACCAUAUC | 2167 |
| AUAUGGUGGUGGAGGCCUG | 2168 | CAGGCCUCCACCACCAUAU | 2169 |
| CCUGUGGCUGCAGCUAGCA | 2170 | UGCUAGCUGCAGCCACAGG | 2171 |
| UGUGGCUGCAGCUAGCAAG | 2172 | CUUGCUAGCUGCAGCCACA | 2173 |
| GUGGCUGCAGCUAGCAAGA | 2174 | UCUUGCUAGCUGCAGCCAC | 2175 |
| UGGCUGCAGCUAGCAAGAG | 2176 | CUCUUGCUAGCUGCAGCCA | 2177 |
| GGCUGCAGCUAGCAAGAGG | 2178 | CCUCUUGCUAGCUGCAGCC | 2179 |
| CUGCAGCUAGCAAGAGGAC | 2180 | GUCCUCUUGCUAGCUGCAG | 2181 |
| CAGCUAGCAAGAGGACCUG | 2182 | CAGGUCCUCUUGCUAGCUG | 2183 |
| GCUAGCAAGAGGACCUGGG | 2184 | CCCAGGUCCUCUUGCUAGC | 2185 |
| AGACCAAGAUGAAGUUUCC | 2186 | GGAAACUUCAUCUUGGUCU | 2187 |
| UGAAGUUUCCCAGGCACAG | 2188 | CUGUGCCUGGGAAACUUCA | 2189 |
| GAAGUUUCCCAGGCACAGG | 2190 | CCUGUGCCUGGGAAACUUC | 2191 |
| UCCCAGGCACAGGGCAUCU | 2192 | AGAUGCCCUGUGCCUGGGA | 2193 |
| GGCAUCUGUGACUGGAGGC | 2194 | GCCUCCAGUCACAGAUGCC | 2195 |
| GCAUCUGUGACUGGAGGCA | 2196 | UGCCUCCAGUCACAGAUGC | 2197 |
| CAACCACCUGGCAAUAUGA | 2198 | UCAUAUUGCCAGGUGGUUG | 2199 |
| AACCACCUGGCAAUAUGAC | 2200 | GUCAUAUUGCCAGGUGGUU | 2201 |
| ACCACCUGGCAAUAUGACU | 2202 | AGUCAUAUUGCCAGGUGGU | 2203 |
| CCACCUGGCAAUAUGACUC | 2204 | GAGUCAUAUUGCCAGGUGG | 2205 |
| CACCUGGCAAUAUGACUCA | 2206 | UGAGUCAUAUUGCCAGGUG | 2207 |
| ACCUGGCAAUAUGACUCAC | 2208 | GUGAGUCAUAUUGCCAGGU | 2209 |
| CCUGGCAAUAUGACUCACU | 2210 | AGUGAGUCAUAUUGCCAGG | 2211 |
| CUGGCAAUAUGACUCACUU | 2212 | AAGUGAGUCAUAUUGCCAG | 2213 |
| UGGCAAUAUGACUCACUUG | 2214 | CAAGUGAGUCAUAUUGCCA | 2215 |
| AAUAUGACUCACUUGACCC | 2216 | GGGUCAAGUGAGUCAUAUU | 2217 |
| CCCUAUGGGACCCAAAUGG | 2218 | CCAUUUGGGUCCCAUAGGG | 2219 |
| CCUAUGGGACCCAAAUGGG | 2220 | CCCAUUUGGGUCCCAUAGG | 2221 |
| CUAUGGGACCCAAAUGGGC | 2222 | GCCCAUUUGGGUCCCAUAG | 2223 |
| UAUGGGACCCAAAUGGGCA | 2224 | UGCCCAUUUGGGUCCCAUA | 2225 |
| AUGGGACCCAAAUGGGCAC | 2226 | GUGCCCAUUUGGGUCCCAU | 2227 |
| CCCAAAUGGGCACUUUCUU | 2228 | AAGAAAGUGCCCAUUUGGG | 2229 |
| CCAAAUGGGCACUUUCUUG | 2230 | CAAGAAAGUGCCCAUUUGG | 2231 |
| CAAAUGGGCACUUUCUUGU | 2232 | ACAAGAAAGUGCCCAUUUG | 2233 |
| AAAUGGGCACUUUCUUGUC | 2234 | GACAAGAAAGUGCCCAUUU | 2235 |
| AAUGGGCACUUUCUUGUCU | 2236 | AGACAAGAAAGUGCCCAUU | 2237 |
| UGGGCACUUUCUUGUCUGA | 2238 | UCAGACAAGAAAGUGCCCA | 2239 |
| GGGCACUUUCUUGUCUGAG | 2240 | CUCAGACAAGAAAGUGCCC | 2241 |
| UGGCUUAUUCCAGGUUGGC | 2242 | GCCAACCUGGAAUAAGCCA | 2243 |
| GGCUUAUUCCAGGUUGGCU | 2244 | AGCCAACCUGGAAUAAGCC | 2245 |
| GCUUAUUCCAGGUUGGCUG | 2246 | CAGCCAACCUGGAAUAAGC | 2247 |
| CUUAUUCCAGGUUGGCUGA | 2248 | UCAGCCAACCUGGAAUAAG | 2249 |
| UUCCAGGUUGGCUGAUGUG | 2250 | CACAUCAGCCAACCUGGAA | 2251 |
| UCCAGGUUGGCUGAUGUGU | 2252 | ACACAUCAGCCAACCUGGA | 2253 |
| CCAGGUUGGCUGAUGUGUU | 2254 | AACACAUCAGCCAACCUGG | 2255 |
| CAGGUUGGCUGAUGUGUUG | 2256 | CAACACAUCAGCCAACCUG | 2257 |
| AGGUUGGCUGAUGUGUUGG | 2258 | CCAACACAUCAGCCAACCU | 2259 |
| GGUUGGCUGAUGUGUUGGG | 2260 | CCCAACACAUCAGCCAACC | 2261 |
| AGAUGGGUAAAGCGUUUCU | 2262 | AGAAACGCUUUACCCAUCU | 2263 |
| GAUGGGUAAAGCGUUUCUU | 2264 | AAGAAACGCUUUACCCAUC | 2265 |
| AUGGGUAAAGCGUUUCUUC | 2266 | GAAGAAACGCUUUACCCAU | 2267 |
| UGGGUAAAGCGUUUCUUCU | 2268 | AGAAGAAACGCUUUACCCA | 2269 |
| GGGUAAAGCGUUUCUUCUA | 2270 | UAGAAGAAACGCUUUACCC | 2271 |
| GGUAAAGCGUUUCUUCUAA | 2272 | UUAGAAGAAACGCUUUACC | 2273 |
| GUAAAGCGUUUCUUCUAAA | 2274 | UUUAGAAGAAACGCUUUAC | 2275 |
| UAAAGCGUUUCUUCUAAAG | 2276 | CUUUAGAAGAAACGCUUUA | 2277 |
| AAAGCGUUUCUUCUAAAGG | 2278 | CCUUUAGAAGAAACGCUUU | 2279 |
| AAGCGUUUCUUCUAAAGGG | 2280 | CCCUUUAGAAGAAACGCUU | 2281 |
| AAAGCAUGAUUUCCUGCCC | 2282 | GGGCAGGAAAUCAUGCUUU | 2283 |
| AAGCAUGAUUUCCUGCCCU | 2284 | AGGGCAGGAAAUCAUGCUU | 2285 |
| AGCAUGAUUUCCUGCCCUA | 2286 | UAGGGCAGGAAAUCAUGCU | 2287 |
| GCAUGAUUUCCUGCCCUAA | 2288 | UUAGGGCAGGAAAUCAUGC | 2289 |
| CAUGAUUUCCUGCCCUAAG | 2290 | CUUAGGGCAGGAAAUCAUG | 2291 |
| AUGAUUUCCUGCCCUAAGU | 2292 | ACUUAGGGCAGGAAAUCAU | 2293 |
| UGAUUUCCUGCCCUAAGUC | 2294 | GACUUAGGGCAGGAAAUCA | 2295 |
| GAUUUCCUGCCCUAAGUCC | 2296 | GGACUUAGGGCAGGAAAUC | 2297 |
| AUUUCCUGCCCUAAGUCCU | 2298 | AGGACUUAGGGCAGGAAAU | 2299 |
| UUUCCUGCCCUAAGUCCUG | 2300 | CAGGACUUAGGGCAGGAAA | 2301 |
| UUCCUGCCCUAAGUCCUGU | 2302 | ACAGGACUUAGGGCAGGAA | 2303 |
| UCCUGCCCUAAGUCCUGUG | 2304 | CACAGGACUUAGGGCAGGA | 2305 |
| AGAAGAUGUCAGGGACUAG | 2306 | CUAGUCCCUGACAUCUUCU | 2307 |
| GAAGAUGUCAGGGACUAGG | 2308 | CCUAGUCCCUGACAUCUUC | 2309 |
| AAGAUGUCAGGGACUAGGG | 2310 | CCCUAGUCCCUGACAUCUU | 2311 |
| AGAUGUCAGGGACUAGGGA | 2312 | UCCCUAGUCCCUGACAUCU | 2313 |

TABLE 3-continued

| Sense Sequence | SEQ ID NO: | Antisense Sequence | SEQ ID NO: |
|---|---|---|---|
| GUCAGGGACUAGGGAGGGA | 2314 | UCCCUCCCUAGUCCCUGAC | 2315 |
| UACUUAGCCUCUCCCAAGA | 2316 | UCUUGGGAGAGGCUAAGUA | 2317 |
| AGGAGGAAGCAGAUAGAUG | 2318 | CAUCUAUCUGCUUCCUCCU | 2319 |
| GGAGGAAGCAGAUAGAUGG | 2320 | CCAUCUAUCUGCUUCCUCC | 2321 |
| GAGGAAGCAGAUAGAUGGU | 2322 | ACCAUCUAUCUGCUUCCUC | 2323 |
| AGGAAGCAGAUAGAUGGUC | 2324 | GACCAUCUAUCUGCUUCCU | 2325 |
| GGAAGCAGAUAGAUGGUCC | 2326 | GGACCAUCUAUCUGCUUCC | 2327 |
| GAAGCAGAUAGAUGGUCCA | 2328 | UGGACCAUCUAUCUGCUUC | 2329 |
| UAGAUGGUCCAGCAGGCUU | 2330 | AAGCCUGCUGGACCAUCUA | 2331 |
| AGAUGGUCCAGCAGGCUUG | 2332 | CAAGCCUGCUGGACCAUCU | 2333 |
| GAUGGUCCAGCAGGCUUGA | 2334 | UCAAGCCUGCUGGACCAUC | 2335 |
| AUGGUCCAGCAGGCUUGAA | 2336 | UUCAAGCCUGCUGGACCAU | 2337 |
| UGGUCCAGCAGGCUUGAAG | 2338 | CUUCAAGCCUGCUGGACCA | 2339 |
| GGUCCAGCAGGCUUGAAGC | 2340 | GCUUCAAGCCUGCUGGACC | 2341 |
| GUCCAGCAGGCUUGAAGCA | 2342 | UGCUUCAAGCCUGCUGGAC | 2343 |
| UCCAGCAGGCUUGAAGCAG | 2344 | CUGCUUCAAGCCUGCUGGA | 2345 |
| CCCAGGGUAAGGGCUGUUG | 2346 | CAACAGCCCUUACCCUGGG | 2347 |
| GGGUAAGGGCUGUUGAGGU | 2348 | ACCUCAACAGCCCUUACCC | 2349 |
| GGUAAGGGCUGUUGAGGUA | 2350 | UACCUCAACAGCCCUUACC | 2351 |
| GUAAGGGCUGUUGAGGUAC | 2352 | GUACCUCAACAGCCCUUAC | 2353 |
| UAAGGGCUGUUGAGGUACC | 2354 | GGUACCUCAACAGCCCUUA | 2355 |
| AAGGGCUGUUGAGGUACCU | 2356 | AGGUACCUCAACAGCCCUU | 2357 |
| AGGGCUGUUGAGGUACCUU | 2358 | AAGGUACCUCAACAGCCCU | 2359 |
| GGGCUGUUGAGGUACCUUA | 2360 | UAAGGUACCUCAACAGCCC | 2361 |
| GGCUGUUGAGGUACCUUAA | 2362 | UUAAGGUACCUCAACAGCC | 2363 |
| GCUGUUGAGGUACCUUAAG | 2364 | CUUAAGGUACCUCAACAGC | 2365 |
| CUGUUGAGGUACCUUAAGG | 2366 | CCUUAAGGUACCUCAACAG | 2367 |
| UGUUGAGGUACCUUAAGGG | 2368 | CCCUUAAGGUACCUCAACA | 2369 |
| UAAGGGAAGGUCAAGAGGG | 2370 | CCCUCUUGACCUUCCCUUA | 2371 |
| AAGGGAAGGUCAAGAGGGA | 2372 | UCCCUCUUGACCUUCCCUU | 2373 |
| CGCUGAGGGAGGAUGCUUA | 2374 | UAAGCAUCCUCCCUCAGCG | 2375 |
| UGAGGGAGGAUGCUUAGGG | 2376 | CCCUAAGCAUCCUCCCUCA | 2377 |
| GGCACUAAGCCUAAGAAGU | 2378 | ACUUCUUAGGCUUAGUGCC | 2379 |
| GCACUAAGCCUAAGAAGUU | 2380 | AACUUCUUAGGCUUAGUGC | 2381 |
| CACUAAGCCUAAGAAGUUC | 2382 | GAACUUCUUAGGCUUAGUG | 2383 |
| ACUAAGCCUAAGAAGUUCC | 2384 | GGAACUUCUUAGGCUUAGU | 2385 |
| AGAUCGAGUCUCGCUCUGU | 2386 | ACAGAGCGAGACUCGAUCU | 2387 |
| GAUCGAGUCUCGCUCUGUC | 2388 | GACAGAGCGAGACUCGAUC | 2389 |
| AUCGAGUCUCGCUCUGUCA | 2390 | UGACAGAGCGAGACUCGAU | 2391 |
| AGUCUCGCUCUGUCACCAG | 2392 | CUGGUGACAGAGCGAGACU | 2393 |
| GUCUCGCUCUGUCACCAGG | 2394 | CCUGGUGACAGAGCGAGAC | 2395 |
| UCUCGCUCUGUCACCAGGC | 2396 | GCCUGGUGACAGAGCGAGA | 2397 |
| CUCGCUCUGUCACCAGGCU | 2398 | AGCCUGGUGACAGAGCGAG | 2399 |
| GUCACCAGGCUGGAGUGCA | 2400 | UGCACUCCAGCCUGGUGAC | 2401 |
| GGCUCACUGCAACCUCCGU | 2402 | ACGGAGGUUGCAGUGAGCC | 2403 |
| GCUCACUGCAACCUCCGUC | 2404 | GACGGAGGUUGCAGUGAGC | 2405 |
| UCCGUCUCCUGGGUUCAAG | 2406 | CUUGAACCCAGGAGACGGA | 2407 |
| CCGUCUCCUGGGUUCAAGU | 2408 | ACUUGAACCCAGGAGACGG | 2409 |
| CGUCUCCUGGGUUCAAGUG | 2410 | CACUUGAACCCAGGAGACG | 2411 |
| GUCUCCUGGGUUCAAGUGA | 2412 | UCACUUGAACCCAGGAGAC | 2413 |
| UGGGUUCAAGUGAUUCUUC | 2414 | GAAGAAUCACUUGAACCCA | 2415 |
| GGGUUCAAGUGAUUCUUCU | 2416 | AGAAGAAUCACUUGAACCC | 2417 |
| GGUUCAAGUGAUUCUUCUG | 2418 | CAGAAGAAUCACUUGAACC | 2419 |
| GUUCAAGUGAUUCUUCUGC | 2420 | GCAGAAGAAUCACUUGAAC | 2421 |
| UUCAAGUGAUUCUUCUGCC | 2422 | GGCAGAAGAAUCACUUGAA | 2423 |
| UCAAGUGAUUCUUCUGCCU | 2424 | AGGCAGAAGAAUCACUUGA | 2425 |
| CGAGCAGCUGGGAUUACAG | 2426 | CUGUAAUCCCAGCUGCUCG | 2427 |
| CAGCUGGGAUUACAGGCGC | 2428 | GCGCCUGUAAUCCCAGCUG | 2429 |
| ACAUGUUGGCCAGGAUGGU | 2430 | ACCAUCCUGGCCAACAUGU | 2431 |
| CAUGUUGGCCAGGAUGGUC | 2432 | GACCAUCCUGGCCAACAUG | 2433 |
| AUGUUGGCCAGGAUGGUCU | 2434 | AGACCAUCCUGGCCAACAU | 2435 |
| UGUUGGCCAGGAUGGUCUC | 2436 | GAGACCAUCCUGGCCAACA | 2437 |
| GUUGGCCAGGAUGGUCUCA | 2438 | UGAGACCAUCCUGGCCAAC | 2439 |
| UUGGCCAGGAUGGUCUCAA | 2440 | UUGAGACCAUCCUGGCCAA | 2441 |
| UGGCCAGGAUGGUCUCAAU | 2442 | AUUGAGACCAUCCUGGCCA | 2443 |
| GGCCAGGAUGGUCUCAAUC | 2444 | GAUUGAGACCAUCCUGGCC | 2445 |
| GCCAGGAUGGUCUCAAUCU | 2446 | AGAUUGAGACCAUCCUGGC | 2447 |
| CCAGGAUGGUCUCAAUCUC | 2448 | GAGAUUGAGACCAUCCUGG | 2449 |
| CAGGAUGGUCUCAAUCUCU | 2450 | AGAGAUUGAGACCAUCCUG | 2451 |
| AGGAUGGUCUCAAUCUCUU | 2452 | AAGAGAUUGAGACCAUCCU | 2453 |
| AUUAUAGGCGUGAGCCACC | 2454 | GGUGGCUCACGCCUAUAAU | 2455 |
| UUAUAGGCGUGAGCCACCG | 2456 | CGGUGGCUCACGCCUAUAA | 2457 |
| UAUAGGCGUGAGCCACCGC | 2458 | GCGGUGGCUCACGCCUAUA | 2459 |
| GCGCCUGGCUUAUACUUUC | 2460 | GAAAGUAUAAGCCAGGCGC | 2461 |
| CGCCUGGCUUAUACUUUCU | 2462 | AGAAAGUAUAAGCCAGGCG | 2463 |
| CCUGGCUUAUACUUUCUUA | 2464 | UAAGAAAGUAUAAGCCAGG | 2465 |

TABLE 3-continued

| Sense Sequence | SEQ ID NO: | Antisense Sequence | SEQ ID NO: |
|---|---|---|---|
| CUGGCUAUACUUUCUUAA | 2466 | UUAAGAAAGUAUAAGCCAG | 2467 |
| CAAAUGUGAGUCAUAAAGA | 2468 | UCUUUAUGACUCACAUUUG | 2469 |
| AAUGUGAGUCAUAAAGAAG | 2470 | CUUCUUUAUGACUCACAUU | 2471 |
| UGAGUCAUAAAGAAGGGUU | 2472 | AACCCUUCUUUAUGACUCA | 2473 |
| AGUCAUAAAGAAGGGUUAG | 2474 | CUAACCCUUCUUUAUGACU | 2475 |
| GUCAUAAAGAAGGGUUAGG | 2476 | CCUAACCCUUCUUUAUGAC | 2477 |
| UCAUAAAGAAGGGUUAGGG | 2478 | CCCUAACCCUUCUUUAUGA | 2479 |
| CAUAAAGAAGGGUUAGGGU | 2480 | ACCCUAACCCUUCUUUAUG | 2481 |
| AAGAAGGGUUAGGGUGAUG | 2482 | CAUCACCCUAACCCUUCUU | 2483 |
| AGAAGGGUUAGGGUGAUGG | 2484 | CCAUCACCCUAACCCUUCU | 2485 |
| GAAGGGUUAGGGUGAUGGU | 2486 | ACCAUCACCCUAACCCUUC | 2487 |
| AAGGGUUAGGGUGAUGGUC | 2488 | GACCAUCACCCUAACCCUU | 2489 |
| AGGGUUAGGGUGAUGGUCC | 2490 | GGACCAUCACCCUAACCCU | 2491 |
| GGGUUAGGGUGAUGGUCCA | 2492 | UGGACCAUCACCCUAACCC | 2493 |
| GGGUGAUGGUCCAGAGCAA | 2494 | UUGCUCUGGACCAUCACCC | 2495 |
| GGUGAUGGUCCAGAGCAAC | 2496 | GUUGCUCUGGACCAUCACC | 2497 |
| ACAGUUCUUCAAGUGUACU | 2498 | AGUACACUUGAAGAACUGU | 2499 |
| CAGUUCUUCAAGUGUACUC | 2500 | GAGUACACUUGAAGAACUG | 2501 |
| AGUUCUUCAAGUGUACUCU | 2502 | AGAGUACACUUGAAGAACU | 2503 |
| CAAGUGUACUCUGUAGGCU | 2504 | AGCCUACAGAGUACACUUG | 2505 |
| AAGUGUACUCUGUAGGCUU | 2506 | AAGCCUACAGAGUACACUU | 2507 |
| GUGUACUCUGUAGGCUUCU | 2508 | AGAAGCCUACAGAGUACAC | 2509 |
| UGUACUCUGUAGGCUUCUG | 2510 | CAGAAGCCUACAGAGUACA | 2511 |
| GUACUCUGUAGGCUUCUGG | 2512 | CCAGAAGCCUACAGAGUAC | 2513 |
| UACUCUGUAGGCUUCUGGG | 2514 | CCCAGAAGCCUACAGAGUA | 2515 |
| GUAGGCUUCUGGGAGGUCC | 2516 | GGACCUCCCAGAAGCCUAC | 2517 |
| UAGGCUUCUGGGAGGUCCC | 2518 | GGGACCUCCCAGAAGCCUA | 2519 |
| AGGCUUCUGGGAGGUCCCU | 2520 | AGGGACCUCCCAGAAGCCU | 2521 |
| GGCUUCUGGGAGGUCCCUU | 2522 | AAGGGACCUCCCAGAAGCC | 2523 |
| GCUUCUGGGAGGUCCCUUU | 2524 | AAAGGGACCUCCCAGAAGC | 2525 |
| CUUCUGGGAGGUCCCUUUU | 2526 | AAAAGGGACCUCCCAGAAG | 2527 |
| UUCUGGGAGGUCCCUUUUC | 2528 | GAAAAGGGACCUCCCAGAA | 2529 |
| UCUGGGAGGUCCCUUUUCA | 2530 | UGAAAAGGGACCUCCCAGA | 2531 |
| CAUGUUAUUGCCUUUUGA | 2532 | UCAAAAGGCAAUAACAUG | 2533 |
| AUUUGCCUUUUGAAUUCUC | 2534 | GAGAAUUCAAAAGGCAAAU | 2535 |
| UUUGCCUUUUGAAUUCUCA | 2536 | UGAGAAUUCAAAAGGCAAA | 2537 |
| UUGCCUUUUGAAUUCUCAU | 2538 | AUGAGAAUUCAAAAGGCAA | 2539 |
| UGCCUUUUGAAUUCUCAUU | 2540 | AAUGAGAAUUCAAAAGGCA | 2541 |
| GCCUUUUGAAUUCUCAUUA | 2542 | UAAUGAGAAUUCAAAAGGC | 2543 |
| AUUGUAUUGUGGAGUUUUC | 2544 | GAAAACUCCACAAUACAAU | 2545 |
| UUGUAUUGUGGAGUUUUCC | 2546 | GGAAAACUCCACAAUACAA | 2547 |
| AGUUUUCCAGAGGCCGUGU | 2548 | ACACGGCCUCUGGAAAACU | 2549 |
| GUUUUCCAGAGGCCGUGUG | 2550 | CACACGGCCUCUGGAAAAC | 2551 |
| UUUUCCAGAGGCCGUGUGA | 2552 | UCACACGGCCUCUGGAAAA | 2553 |
| UUUCCAGAGGCCGUGUGAC | 2554 | GUCACACGGCCUCUGGAAA | 2555 |
| UUCCAGAGGCCGUGUGACA | 2556 | UGUCACACGGCCUCUGGAA | 2557 |
| UCCAGAGGCCGUGUGACAU | 2558 | AUGUCACACGGCCUCUGGA | 2559 |
| CCAGAGGCCGUGUGACAUG | 2560 | CAUGUCACACGGCCUCUGG | 2561 |
| CAGAGGCCGUGUGACAUGU | 2562 | ACAUGUCACACGGCCUCUG | 2563 |
| AGAGGCCGUGUGACAUGUG | 2564 | CACAUGUCACACGGCCUCU | 2565 |
| GCCGUGUGACAUGUGAUUA | 2566 | UAAUCACAUGUCACACGGC | 2567 |
| CCGUGUGACAUGUGAUUAC | 2568 | GUAAUCACAUGUCACACGG | 2569 |
| CGUGUGACAUGUGAUUACA | 2570 | UGUAAUCACAUGUCACACG | 2571 |
| GAUUACAUCAUCUUUCUGA | 2572 | UCAGAAAGAUGAUGUAAUC | 2573 |
| AUUACAUCAUCUUUCUGAC | 2574 | GUCAGAAAGAUGAUGUAAU | 2575 |
| UUACAUCAUCUUUCUGACA | 2576 | UGUCAGAAAGAUGAUGUAA | 2577 |
| UACAUCAUCUUUCUGACAU | 2578 | AUGUCAGAAAGAUGAUGUA | 2579 |
| AUCUUUCUGACAUCAUUGU | 2580 | ACAAUGAUGUCAGAAAGAU | 2581 |
| AUUGUUAAUGGAAUGUGUG | 2582 | CACACAUUCCAUUAACAAU | 2583 |

In some embodiments, the siRNA molecules comprise or consist of the nucleotide sequences (sense and antisense strands) shown in Table 4.

TABLE 4

| Sense Sequence | SEQ ID NO: | Antisense Sequence | SEQ ID NO: |
|---|---|---|---|
| AAAGUGACUAAGAUGCUAA | 2584 | UUAGCAUCUUAGUCACUUU | 2585 |
| AAGUGACUAAGAUGCUAAG | 2586 | CUUAGCAUCUUAGUCACUU | 2587 |
| AGUGACUAAGAUGCUAAGA | 2588 | UCUUAGCAUCUUAGUCACU | 2589 |
| GUGACUAAGAUGCUAAGAG | 2590 | CUCUUAGCAUCUUAGUCAC | 2591 |
| UGACUAAGAUGCUAAGAGC | 2592 | GCUCUUAGCAUCUUAGUCA | 2593 |
| GACUAAGAUGCUAAGAGCG | 2594 | CGCUCUUAGCAUCUUAGUC | 2595 |
| ACUAAGAUGCUAAGAGCGU | 2596 | ACGCUCUUAGCAUCUUAGU | 2597 |
| CUAAGAUGCUAAGAGCGUA | 2598 | UACGCUCUUAGCAUCUUAG | 2599 |
| UAAGAUGCUAAGAGCGUAU | 2600 | AUACGCUCUUAGCAUCUUA | 2601 |
| AAGAUGCUAAGAGCGUAUU | 2602 | AAUACGCUCUUAGCAUCUU | 2603 |
| AGAUGCUAAGAGCGUAUUU | 2604 | AAAUACGCUCUUAGCAUCU | 2605 |

TABLE 4-continued

| Sense Sequence | SEQ ID NO: | Antisense Sequence | SEQ ID NO: |
| --- | --- | --- | --- |
| GAUGCUAAGAGCGUAUUUA | 2606 | UAAAUACGCUCUUAGCAUC | 2607 |
| AUGCUAAGAGCGUAUUUAU | 2608 | AUAAAUACGCUCUUAGCAU | 2609 |
| UAAGAGCGUAUUUAUAGCU | 2610 | AGCUAUAAAUACGCUCUUA | 2611 |
| AGAGCGUAUUUAUAGCUGA | 2612 | UCAGCUAUAAAUACGCUCU | 2613 |
| GAGCGUAUUUAUAGCUGAG | 2614 | CUCAGCUAUAAAUACGCUC | 2615 |
| AGCGUAUUUAUAGCUGAGC | 2616 | GCUCAGCUAUAAAUACGCU | 2617 |
| GCGUAUUUAUAGCUGAGCU | 2618 | AGCUCAGCUAUAAAUACGC | 2619 |
| CGUAUUUAUAGCUGAGCUC | 2620 | GAGCUCAGCUAUAAAUACG | 2621 |
| GUAUUUAUAGCUGAGCUCU | 2622 | AGAGCUCAGCUAUAAAUAC | 2623 |
| UAUUUAUAGCUGAGCUCUG | 2624 | CAGAGCUCAGCUAUAAAUA | 2625 |
| AUUUAUAGCUGAGCUCUGA | 2626 | UCAGAGCUCAGCUAUAAAU | 2627 |
| UUUAUAGCUGAGCUCUGAC | 2628 | GUCAGAGCUCAGCUAUAAA | 2629 |
| UUAUAGCUGAGCUCUGACG | 2630 | CGUCAGAGCUCAGCUAUAA | 2631 |
| AGCUGAGCUCUGACGUAAG | 2632 | CUUACGUCAGAGCUCAGCU | 2633 |
| GCUGAGCUCUGACGUAAGU | 2634 | ACUUACGUCAGAGCUCAGC | 2635 |
| CUGAGCUCUGACGUAAGUG | 2636 | CACUUACGUCAGAGCUCAG | 2637 |
| UGAGCUCUGACGUAAGUGU | 2638 | ACACUUACGUCAGAGCUCA | 2639 |
| GAGCUCUGACGUAAGUGUC | 2640 | GACACUUACGUCAGAGCUC | 2641 |
| AGGCCAGGCACAGCAGCAA | 2642 | UUGCUGCUGUGCCUGGCCU | 2643 |
| CAGCAAGCGGGUGGAAGA | 2644 | UCUUCCCACCCGCUUGCUG | 2645 |
| AGCAAGCGGGUGGGAAGAG | 2646 | CUCUUCCCACCCGCUUGCU | 2647 |
| CAAGCGGGUGGGAAGAGCU | 2648 | AGCUCUUCCCACCCGCUUG | 2649 |
| GGGCAUCUGACAGUGAGGG | 2650 | CCCUCACUGUCAGAUGCCC | 2651 |
| GGCAUCUGACAGUGAGGGU | 2652 | ACCCUCACUGUCAGAUGCC | 2653 |
| GUGACUCCUGCAGCCACUU | 2654 | AAGUGGCUGCAGGAGUCAC | 2655 |
| UGACUCCUGCAGCCACUUC | 2656 | GAAGUGGCUGCAGGAGUCA | 2657 |
| ACUCCUGCAGCCACUUCUU | 2658 | AAGAAGUGGCUGCAGGAGU | 2659 |
| CUCCUGCAGCCACUUCUUG | 2660 | CAAGAAGUGGCUGCAGGAG | 2661 |
| UCCUGCAGCCACUUCUUGU | 2662 | ACAAGAAGUGGCUGCAGGA | 2663 |
| CCUGCAGCCACUUCUUGUC | 2664 | GACAAGAAGUGGCUGCAGG | 2665 |
| CUGCAGCCACUUCUUGUCA | 2666 | UGACAAGAAGUGGCUGCAG | 2667 |
| UGACUGCCUACUGAUACCA | 2668 | UGGUAUCAGUAGGCAGUCA | 2669 |
| GACUGCCUACUGAUACCAA | 2670 | UUGGUAUCAGUAGGCAGUC | 2671 |
| ACAGGUAAGCCGUCUGAGG | 2672 | CCUCAGACGGCUUACCUGU | 2673 |
| CAGGUAAGCCGUCUGAGGC | 2674 | GCCUCAGACGGCUUACCUG | 2675 |
| AGGUAAGCCGUCUGAGGCA | 2676 | UGCCUCAGACGGCUUACCU | 2677 |
| GGUAAGCCGUCUGAGGCAC | 2678 | GUGCCUCAGACGGCUUACC | 2679 |
| GUAAGCCGUCUGAGGCACC | 2680 | GGUGCCUCAGACGGCUUAC | 2681 |
| UAAGCCGUCUGAGGCACCA | 2682 | UGGUGCCUCAGACGGCUUA | 2683 |
| AAGCCGUCUGAGGCACCAC | 2684 | GUGGUGCCUCAGACGGCUU | 2685 |
| UAGAUACCUCCACUUUGCU | 2686 | AGCAAAGUGGAGGUAUCUA | 2687 |
| GAUACCUCCACUUUGCUGA | 2688 | UCAGCAAAGUGGAGGUAUC | 2689 |
| AUACCUCCACUUUGCUGAC | 2690 | GUCAGCAAAGUGGAGGUAU | 2691 |
| CCACUUUGCUGACCAAUGU | 2692 | ACAUUGGUCAGCAAAGUGG | 2693 |
| UUUGCUGACCAAUGUUCCA | 2694 | UGGAACAUUGGUCAGCAAA | 2695 |
| UUGCUGACCAAUGUUCCAG | 2696 | CUGGAACAUUGGUCAGCAA | 2697 |
| UGCUGACCAAUGUUCCAGA | 2698 | UCUGGAACAUUGGUCAGCA | 2699 |
| GCUGACCAAUGUUCCAGAC | 2700 | GUCUGGAACAUUGGUCAGC | 2701 |
| CUGACCAAUGUUCCAGACC | 2702 | GGUCUGGAACAUUGGUCAG | 2703 |
| CCAAUGUUCCAGACCCGAG | 2704 | CUCGGGUCUGGAACAUUGG | 2705 |
| GGUAGAGGGCUGUCAUUUC | 2706 | GAAAUGACAGCCCUCUACC | 2707 |
| GUAGAGGGCUGUCAUUUCC | 2708 | GGAAAUGACAGCCCUCUAC | 2709 |
| UGUCAUUUCCCAGCCCAAC | 2710 | GUUGGGCUGGGAAAUGACA | 2711 |
| GAAUGGUUGCUGGGAGCUG | 2712 | CAGCUCCCAGCAACCAUUC | 2713 |
| CUGGACAGAGCUCUUGAAU | 2714 | AUUCAAGAGCUCUGUCCAG | 2715 |
| UGGACAGAGCUCUUGAAUG | 2716 | CAUUCAAGAGCUCUGUCCA | 2717 |
| CAGAGCUCUUGAAUGUGUU | 2718 | AACACAUUCAAGAGCUCUG | 2719 |
| AGAGCUCUUGAAUGUGUUU | 2720 | AAACACAUUCAAGAGCUCU | 2721 |
| AUGUGUUUCAGAGCUUGGG | 2722 | CCCAAGCUCUGAAACACAU | 2723 |
| AAAUGCAGGGUGGACAGGA | 2724 | UCCUGUCCACCCUGCAUUU | 2725 |
| AAUGCAGGGUGGACAGGAG | 2726 | CUCCUGUCCACCCUGCAUU | 2727 |
| AUGCAGGGUGGACAGGAGG | 2728 | CCUCCUGUCCACCCUGCAU | 2729 |
| GGUGGACAGGAGGGUCUAA | 2730 | UUAGACCCUCCUGUCCACC | 2731 |
| GUGGACAGGAGGGUCUAAU | 2732 | AUUAGACCCUCCUGUCCAC | 2733 |
| UGGACAGGAGGGUCUAAUC | 2734 | GAUUAGACCCUCCUGUCCA | 2735 |
| GGACAGGAGGGUCUAAUCG | 2736 | CGAUUAGACCCUCCUGUCC | 2737 |
| GACAGGAGGGUCUAAUCGU | 2738 | ACGAUUAGACCCUCCUGUC | 2739 |
| ACAGGAGGGUCUAAUCGUC | 2740 | GACGAUUAGACCCUCCUGU | 2741 |
| CAGGAGGGUCUAAUCGUCU | 2742 | AGACGAUUAGACCCUCCUG | 2743 |
| AGGAGGGUCUAAUCGUCUC | 2744 | GAGACGAUUAGACCCUCCU | 2745 |
| GGAGGGUCUAAUCGUCUCA | 2746 | UGAGACGAUUAGACCCUCC | 2747 |
| GAGGGUCUAAUCGUCUCAG | 2748 | CUGAGACGAUUAGACCCUC | 2749 |
| AGGGUCUAAUCGUCUCAGU | 2750 | ACUGAGACGAUUAGACCCU | 2751 |
| GGGUCUAAUCGUCUCAGUG | 2752 | CACUGAGACGAUUAGACCC | 2743 |
| GGUCUAAUCGUCUCAGUGC | 2754 | GCACUGAGACGAUUAGACC | 2755 |
| CCCACCAAAGAGUGCCCUG | 2756 | CAGGGCACUCUUUGGUGGG | 2757 |

TABLE 4-continued

| Sense Sequence | SEQ ID NO: | Antisense Sequence | SEQ ID NO: |
|---|---|---|---|
| CCACCAAAGAGUGCCCUGA | 2758 | UCAGGGCACUCUUUGGUGG | 2759 |
| CCAAAGAGUGCCCUGAGGU | 2760 | ACCUCAGGGCACUCUUUGG | 2761 |
| CAAAGAGUGCCCUGAGGUU | 2762 | AACCUCAGGGCACUCUUUG | 2763 |
| AAAGAGUGCCCUGAGGUUC | 2764 | GAACCUCAGGGCACUCUUU | 2765 |
| AAGAGUGCCCUGAGGUUCU | 2766 | AGAACCUCAGGGCACUCUU | 2767 |
| AGAGUGCCCUGAGGUUCUA | 2768 | UAGAACCUCAGGGCACUCU | 2769 |
| GAGUGCCCUGAGGUUCUAG | 2770 | CUAGAACCUCAGGGCACUC | 2771 |
| AGUGCCCUGAGGUUCUAGG | 2772 | CCUAGAACCUCAGGGCACU | 2773 |
| GUGCCCUGAGGUUCUAGGA | 2774 | UCCUAGAACCUCAGGGCAC | 2775 |
| CCUGAGGUUCUAGGAAGAG | 2776 | CUCUUCCUAGAACCUCAGG | 2777 |
| CUGAGGUUCUAGGAAGAGC | 2778 | GCUCUUCCUAGAACCUCAG | 2779 |
| UUCUAGGAAGAGCCUGGUA | 2780 | UACCAGGCUCUUCCUAGAA | 2781 |
| UCUAGGAAGAGCCUGGUAC | 2782 | GUACCAGGCUCUUCCUAGA | 2783 |
| CUAGGAAGAGCCUGGUACA | 2784 | UGUACCAGGCUCUUCCUAG | 2785 |
| UAGGAAGAGCCUGGUACAU | 2786 | AUGUACCAGGCUCUUCCUA | 2787 |
| AGGAAGAGCCUGGUACAUC | 2788 | GAUGUACCAGGCUCUUCCU | 2789 |
| GGAAGAGCCUGGUACAUCA | 2790 | UGAUGUACCAGGCUCUUCC | 2791 |
| GAAGAGCCUGGUACAUCAC | 2792 | GUGAUGUACCAGGCUCUUC | 2793 |
| AAGAGCCUGGUACAUCACC | 2794 | GGUGAUGUACCAGGCUCUU | 2795 |
| UCACCAAGCUCCAUUGCCA | 2796 | UGGCAAUGGAGCUUGGUGA | 2797 |
| CACCAAGCUCCAUUGCCAC | 2798 | GUGGCAAUGGAGCUUGGUG | 2799 |
| ACCAAGCUCCAUUGCCACG | 2800 | CGUGGCAAUGGAGCUUGGU | 2801 |
| CCAAGCUCCAUUGCCACGU | 2802 | ACGUGGCAAUGGAGCUUGG | 2803 |
| CAAGCUCCAUUGCCACGUG | 2804 | CACGUGGCAAUGGAGCUUG | 2805 |
| AAGCUCCAUUGCCACGUGU | 2806 | ACACGUGGCAAUGGAGCUU | 2807 |
| AGCUCCAUUGCCACGUGUU | 2808 | AACACGUGGCAAUGGAGCU | 2809 |
| CUCCAUUGCCACGUGUUUG | 2810 | CAAACACGUGGCAAUGGAG | 2811 |
| UCCAUUGCCACGUGUUUGU | 2812 | ACAAACACGUGGCAAUGGA | 2813 |
| CCAUUGCCACGUGUUUGUG | 2814 | CACAAACACGUGGCAAUGG | 2815 |
| CAUUGCCACGUGUUUGUGU | 2816 | ACACAAACACGUGGCAAUG | 2817 |
| AAAGGUAGCAGUGAUGUGG | 2818 | CCACAUCACUGCUACCUUU | 2819 |
| AAGGUAGCAGUGAUGUGGA | 2820 | UCCACAUCACUGCUACCUU | 2821 |
| AGGUAGCAGUGAUGUGGAU | 2822 | AUCCACAUCACUGCUACCU | 2823 |
| GGUAGCAGUGAUGUGGAUC | 2824 | GAUCCACAUCACUGCUACC | 2825 |
| GUAGCAGUGAUGUGGAUCC | 2826 | GGAUCCACAUCACUGCUAC | 2827 |
| UAGCAGUGAUGUGGAUCCU | 2828 | AGGAUCCACAUCACUGCUA | 2829 |
| AGCAGUGAUGUGGAUCCUG | 2830 | CAGGAUCCACAUCACUGCU | 2831 |
| GCAGUGAUGUGGAUCCUGA | 2832 | UCAGGAUCCACAUCACUGC | 2833 |
| CAGUGAUGUGGAUCCUGAA | 2834 | UUCAGGAUCCACAUCACUG | 2835 |
| AGUGAUGUGGAUCCUGAAG | 2836 | CUUCAGGAUCCACAUCACU | 2837 |
| GUGAUGUGGAUCCUGAAGA | 2838 | UCUUCAGGAUCCACAUCAC | 2839 |
| GAUGUGGAUCCUGAAGACA | 2840 | UGUCUUCAGGAUCCACAUC | 2841 |
| AUGUGGAUCCUGAAGACAG | 2842 | CUGUCUUCAGGAUCCACAU | 2843 |
| UGUGGAUCCUGAAGACAGU | 2844 | ACUGUCUUCAGGAUCCACA | 2845 |
| GUGGAUCCUGAAGACAGUC | 2846 | GACUGUCUUCAGGAUCCAC | 2847 |
| AUCCUGAAGACAGUCUCUC | 2848 | GAGAGACUGUCUUCAGGAU | 2849 |
| UCCUGAAGACAGUCUCUCU | 2850 | AGAGAGACUGUCUUCAGGA | 2851 |
| AGACAGUCUCUCUUCUCUG | 2852 | CAGAGAAGAGAGACUGUCU | 2853 |
| AGUCUCUCUUCUCUGGCAG | 2854 | CUGCCAGAGAAGAGAGACU | 2855 |
| CUCUUCUCUGGCAGUGUGA | 2856 | UCACACUGCAGAGAAGAG | 2857 |
| AACCAGCUUGUCCCUGUCU | 2858 | AGACAGGGACAAGCUGGUU | 2859 |
| CAGCUUGUCCCUGUCUCUU | 2860 | AAGAGACAGGGACAAGCUG | 2861 |
| CAGCUGCUGUCCAGAGGCA | 2862 | UGCCUCUGGACAGCAGCUG | 2863 |
| CACGGCACUGCCACAUGGU | 2864 | ACCAUGUGGCAGUGCCGUG | 2865 |
| ACGGCACUGCCACAUGGUG | 2866 | CACCAUGUGGCAGUGCCGU | 2867 |
| AUGGUGGACACUGGUGGUA | 2868 | UACCACCAGUGUCCACCAU | 2869 |
| UGGUGGACACUGGUGGUAC | 2870 | GUACCACCAGUGUCCACCA | 2871 |
| GGUGGACACUGGUGGUACU | 2872 | AGUACCACCAGUGUCCACC | 2873 |
| GUGGACACUGGUGGUACUG | 2874 | CAGUACCACCAGUGUCCAC | 2875 |
| UGGACACUGGUGGUACUGA | 2876 | UCAGUACCACCAGUGUCCA | 2877 |
| GGACACUGGUGGUACUGAG | 2878 | CUCAGUACCACCAGUGUCC | 2879 |
| GACACUGGUGGUACUGAGG | 2880 | CCUCAGUACCACCAGUGUC | 2881 |
| ACACUGGUGGUACUGAGGU | 2882 | ACCUCAGUACCACCAGUGU | 2883 |
| CACUGGUGGUACUGAGGUC | 2884 | GACCUCAGUACCACCAGUG | 2885 |
| ACUGGUGGUACUGAGGUCC | 2886 | GGACCUCAGUACCACCAGU | 2887 |
| CUGGUGGUACUGAGGUCCA | 2888 | UGGACCUCAGUACCACCAG | 2889 |
| UACUGAGGUCCAGCCUUCC | 2890 | GGAAGGCUGGACCUCAGUA | 2891 |
| CUGAGGUCCAGCCUUCCAA | 2892 | UUGGAAGGCUGGACCUCAG | 2893 |
| UGAGGUCCAGCCUUCCAAU | 2894 | AUUGGAAGGCUGGACCUCA | 2895 |
| GAGGUCCAGCCUUCCAAUU | 2896 | AAUUGGAAGGCUGGACCUC | 2897 |
| AGGUCCAGCCUUCCAAUUA | 2898 | UAAUUGGAAGGCUGGACCU | 2899 |
| GGUCCAGCCUUCCAAUUAG | 2900 | CUAAUUGGAAGGCUGGACC | 2901 |
| GUCCAGCCUUCCAAUUAGG | 2902 | CCUAAUUGGAAGGCUGGAC | 2903 |
| UCCAGCCUUCCAAUUAGGA | 2904 | UCCUAAUUGGAAGGCUGGA | 2905 |
| GCCUAGAUCUAAUAGUCUC | 2906 | GAGACUAUUAGAUCUAGGC | 2907 |
| CCUAGAUCUAAUAGUCUCU | 2908 | AGAGACUAUUAGAUCUAGG | 2909 |

TABLE 4-continued

| Sense Sequence | SEQ ID NO: | Antisense Sequence | SEQ ID NO: |
|---|---|---|---|
| CUAGAUCUAAUAGUCUCUC | 2910 | GAGAGACUAUUAGAUCUAG | 2911 |
| UAGAUCUAAUAGUCUCUCU | 2912 | AGAGAGACUAUUAGAUCUA | 2913 |
| CUAAUAGUCUCUCUUGACA | 2914 | UGUCAAGAGAGACUAUUAG | 2915 |
| UAAUAGUCUCUCUUGACAG | 2916 | CUGUCAAGAGAGACUAUUA | 2917 |
| AAUAGUCUCUCUUGACAGC | 2918 | GCUGUCAAGAGAGACUAUU | 2919 |
| AUGAGCAAAGUGGAGUAAA | 2920 | UUUACUCCACUUUGCUCAU | 2921 |
| UGAGCAAAGUGGAGUAAAG | 2922 | CUUUACUCCACUUUGCUCA | 2923 |
| GAGCAAAGUGGAGUAAAGA | 2924 | UCUUUACUCCACUUUGCUC | 2925 |
| GCAAAGUGGAGUAAAGACA | 2926 | UGUCUUUACUCCACUUUGC | 2927 |
| CAAAGUGGAGUAAAGACAC | 2928 | GUGUCUUUACUCCACUUUG | 2929 |
| AUUUCCAAAUCACACCCAC | 2930 | GUGGGUGUGAUUUGGAAAU | 2931 |
| UCCAAAUCACACCCACUUC | 2932 | GAAGUGGGUGUGAUUUGGA | 2933 |
| CCAAAUCACACCCACUUCC | 2934 | GGAAGUGGGUGUGAUUUGG | 2935 |
| AAAAGCUAGCAUGAGGCCC | 2936 | GGGCCUCAUGCUAGCUUUU | 2937 |
| AAAGCUAGCAUGAGGCCCA | 2938 | UGGGCCUCAUGCUAGCUUU | 2939 |
| AAGCUAGCAUGAGGCCCAC | 2940 | GUGGGCCUCAUGCUAGCUU | 2941 |
| CCCACCUUCAUGAAUUCAA | 2942 | UUGAAUUCAUGAAGGUGGG | 2943 |
| ACCUUCAUGAAUUCAAUGU | 2944 | ACAUUGAAUUCAUGAAGGU | 2945 |
| CCUUCAUGAAUUCAAUGUG | 2946 | CACAUUGAAUUCAUGAAGG | 2947 |
| CUUCAUGAAUUCAAUGUGG | 2948 | CCACAUUGAAUUCAUGAAG | 2949 |
| UCAUGAAUUCAAUGUGGAG | 2950 | CUCCACAUUGAAUUCAUGA | 2951 |
| CAUGAAUUCAAUGUGGAGG | 2952 | CCUCCACAUUGAAUUCAUG | 2953 |
| CAUUUAAAGCCAGUGAGGA | 2954 | UCCUCACUGGCUUUAAAUG | 2955 |
| UUUAAAGCCAGUGAGGACU | 2956 | AGUCCUCACUGGCUUUAAA | 2957 |
| AGGACUGGGUGUGGUGGCU | 2958 | AGCCACCACACCCAGUCCU | 2959 |
| GACUGGGUGUGGUGGCUCA | 2960 | UGAGCCACCACACCCAGUC | 2961 |
| ACUGGGUGUGGUGGCUCAU | 2962 | AUGAGCCACCACACCCAGU | 2963 |
| CUGGGUGUGGUGGCUCAUG | 2964 | CAUGAGCCACCACACCCAG | 2965 |
| UGGGUGUGGUGGCUCAUGU | 2966 | ACAUGAGCCACCACACCCA | 2967 |
| GGGUGUGGUGGCUCAUGUC | 2968 | GACAUGAGCCACCACACCC | 2969 |
| GGUGUGGUGGCUCAUGUCU | 2970 | AGACAUGAGCCACCACACC | 2971 |
| GUGUGGUGGCUCAUGUCUA | 2972 | UAGACAUGAGCCACCACAC | 2973 |
| UGUGGUGGCUCAUGUCUAU | 2974 | AUAGACAUGAGCCACCACA | 2975 |
| GAGGAUCGCUUGAGCCCAG | 2976 | CUGGGCUCAAGCGAUCCUC | 2977 |
| AAAUAAAUUAGCCUGUGUG | 2978 | CACACAGGCUAAUUUAUUU | 2979 |
| AAUUAGCCUGUGUGGUGUG | 2980 | CACACCACACAGGCUAAUU | 2981 |
| AUUAGCCUGUGUGGUGUGG | 2982 | CCACACCACACAGGCUAAU | 2983 |
| GCCUGUGUGGUGUGGUGUG | 2984 | CACACCACACCACACAGGC | 2985 |
| UGUGGUGUGGUGUGGUUGG | 2986 | CCAACCACACCACACCACA | 2987 |
| GGUGUGGUGUGGUUGGUGU | 2988 | ACACCAACCACACCACACC | 2989 |
| UGUGGUUGGUGUGGUGGCA | 2990 | UGCCACCACACCAACCACA | 2991 |
| GUGGUUGGUGUGGUGGCAC | 2992 | GUGCCACCACACCAACCAC | 2993 |
| UGGUUGGUGUGGUGGCACG | 2994 | CGUGCCACCACACCAACCA | 2995 |
| CACGCACCUGUAGACUUAG | 2996 | CUAAGUCUACAGGUGCUG | 2997 |
| ACGCACCUGUAGACUUAGC | 2998 | GCUAAGUCUACAGGUGCGU | 2999 |
| AGACUUAGCUACUCUGGAA | 3000 | UUCCAGAGUAGCUAAGUCU | 3001 |
| GACUUAGCUACUCUGGAAG | 3002 | CUUCCAGAGUAGCUAAGUC | 3003 |
| ACUUAGCUACUCUGGAAGC | 3004 | GCUUCCAGAGUAGCUAAGU | 3005 |
| GGAAGAAUCACUUAACCCA | 3006 | UGGGUUAAGUGAUUCUUCC | 3007 |
| UCACUUAACCCAGGAGGUC | 3008 | GACCUCCUGGGUUAAGUGA | 3009 |
| UUAACCCAGGAGGUCAAGG | 3010 | CCUUGACCUCCUGGGUUAA | 3011 |
| UAACCCAGGAGGUCAAGGC | 3012 | GCCUUGACCUCCUGGGUUA | 3013 |
| GUCAAGGCUGCAGUGAGCU | 3014 | AGCUCACUGCAGCCUUGAC | 3015 |
| UCAAGGCUGCAGUGAGCUG | 3016 | CAGCUCACUGCAGCCUUGA | 3017 |
| CAAGGCUGCAGUGAGCUGU | 3018 | ACAGCUCACUGCAGCCUUG | 3019 |
| AAGGCUGCAGUGAGCUGUG | 3020 | CACAGCUCACUGCAGCCUU | 3021 |
| CUGCAGUGAGCUGUGAUCA | 3022 | UGAUCACAGCUCACUGCAG | 3023 |
| GUCAGGUGCGGUGGCUCAU | 3024 | AUGAGCCACCGCACCUGAC | 3025 |
| UCAGGUGCGGUGGCUCAUG | 3026 | CAUGAGCCACCGCACCUGA | 3027 |
| UGCGGUGGCUCAUGCCUGU | 3028 | ACAGGCAUGAGCCACCGCA | 3029 |
| GCGGUGGCUCAUGCCUGUA | 3030 | UACAGGCAUGAGCCACCGC | 3031 |
| CGGUGGCUCAUGCCUGUAA | 3032 | UUACAGGCAUGAGCCACCG | 3033 |
| GGUGGCUCAUGCCUGUAAU | 3034 | AUUACAGGCAUGAGCCACC | 3035 |
| GUGGCUCAUGCCUGUAAUC | 3036 | GAUUACAGGCAUGAGCCAC | 3037 |
| UGGCUCAUGCCUGUAAUCC | 3038 | GGAUUACAGGCAUGAGCCA | 3039 |
| GGCUCAUGCCUGUAAUCCC | 3040 | GGGAUUACAGGCAUGAGCC | 3041 |
| AUGCCUGUAAUCCCAGCAC | 3042 | GUGCUGGGAUUACAGGCAU | 3043 |
| CAGCACUUUGGGAGGCCGA | 3044 | UCGGCCUCCCAAAGUGCUG | 3045 |
| AGCACUUUGGGAGGCCGAG | 3046 | CUCGGCCUCCCAAAGUGCU | 3047 |
| GCACCUGUAGUCCCAGCGA | 3048 | UCGCUGGGACUACAGGUGC | 3049 |
| CACCUGUAGUCCCAGCGAC | 3050 | GUCGCUGGGACUACAGGUG | 3051 |
| GGAGGCUGAGGCAGAAGAA | 3052 | UUCUUCUGCCUCAGCCUCC | 3053 |
| GAGGCUGAGGCAGAAGAAU | 3054 | AUUCUUCUGCCUCAGCCUC | 3055 |
| AGGCUGAGGCAGAAGAAUG | 3056 | CAUUCUUCUGCCUCAGCCU | 3057 |
| GGCUGAGGCAGAAGAAUGG | 3058 | CCAUUCUUCUGCCUCAGCC | 3059 |
| GCUGAGGCAGAAGAAUGGU | 3060 | ACCAUUCUUCUGCCUCAGC | 3061 |

TABLE 4-continued

| Sense Sequence | SEQ ID NO: | Antisense Sequence | SEQ ID NO: |
|---|---|---|---|
| CUGAGGCAGAAGAAUGGUG | 3062 | CACCAUUCUUCUGCCUCAG | 3063 |
| UGAGGCAGAAGAAUGGUGU | 3064 | ACACCAUUCUUCUGCCUCA | 3065 |
| GAGCUUGCAGUGAGCCGAG | 3066 | CUCGGCUCACUGCAAGCUC | 3067 |
| AAAAUGUGGUCAGGAGGGC | 3068 | GCCCUCCUGACCACAUUUU | 3069 |
| AACCAAGACUGCUGUAUUU | 3070 | AAAUACAGCAGUCUUGGUU | 3071 |
| ACCAAGACUGCUGUAUUUG | 3072 | CAAAUACAGCAGUCUUGGU | 3073 |
| CCAAGACUGCUGUAUUUGC | 3074 | GCAAAUACAGCAGUCUUGG | 3075 |
| CAAGACUGCUGUAUUUGCC | 3076 | GGCAAAUACAGCAGUCUUG | 3077 |
| AAGACUGCUGUAUUUGCCU | 3078 | AGGCAAAUACAGCAGUCUU | 3079 |
| GCUGUAUUUGCCUUGCUUU | 3080 | AAAGCAAGGCAAAUACAGC | 3081 |
| UUGCCUUGCUUUGUUGUCA | 3082 | UGACAACAAAGCAAGGCAA | 3083 |
| UGCCUUGCUUUGUUGUCAA | 3084 | UUGACAACAAAGCAAGGCA | 3085 |
| UUGUUGUCAAAAGCUCUUA | 3086 | UAAGAGCUUUUGACAACAA | 3087 |
| UGUUGUCAAAAGCUCUUAG | 3088 | CUAAGAGCUUUUGACAACA | 3089 |
| GUUGUCAAAAGCUCUUAGA | 3090 | UCUAAGAGCUUUUGACAAC | 3091 |
| UUGUCAAAAGCUCUUAGAG | 3092 | CUCUAAGAGCUUUUGACAA | 3093 |
| UCUUAGAGCUCCCAUUUUC | 3094 | GAAAAUGGGAGCUCUAAGA | 3095 |
| ACUUAGGAGGCUGAGGCA | 3096 | UGCCUCAGCCUCCUAAAGU | 3097 |
| CUUUAGGAGGCUGAGGCAA | 3098 | UUGCCUCAGCCUCCUAAAG | 3099 |
| UUUAGGAGGCUGAGGCAAG | 3100 | CUUGCCUCAGCCUCCUAAA | 3101 |
| UUAGGAGGCUGAGGCAAGU | 3102 | ACUUGCCUCAGCCUCCUAA | 3103 |
| UAGGAGGCUGAGGCAAGUG | 3104 | CACUUGCCUCAGCCUCCUA | 3105 |
| AGGAGGCUGAGGCAAGUGG | 3106 | CCACUUGCCUCAGCCUCCU | 3107 |
| GGAGGCUGAGGCAAGUGGA | 3108 | UCCACUUGCCUCAGCCUCC | 3109 |
| GAGGCUGAGGCAAGUGGAU | 3110 | AUCCACUUGCCUCAGCCUC | 3111 |
| GUGGAUUGCUUGAGCCCAG | 3112 | CUGGGCUCAAGCAAUCCAC | 3113 |
| UGGAUUGCUUGAGCCCAGG | 3114 | CCUGGGCUCAAGCAAUCCA | 3115 |
| GGAUUGCUUGAGCCCAGGA | 3116 | UCCUGGGCUCAAGCAAUCC | 3117 |
| GAUUGCUUGAGCCCAGGAG | 3118 | CUCCUGGGCUCAAGCAAUC | 3119 |
| AUUGCUUGAGCCCAGGAGU | 3120 | ACUCCUGGGCUCAAGCAAU | 3121 |
| UUGCUUGAGCCCAGGAGUU | 3122 | AACUCCUGGGCUCAAGCAA | 3123 |
| UGCUUGAGCCCAGGAGUUC | 3124 | GAACUCCUGGGCUCAAGCA | 3125 |
| UGAGCCCAGGAGUUCAAGA | 3126 | UCUUGAACUCCUGGGCUCA | 3127 |
| AUUAGCCAGGUGUGGUGGU | 3128 | ACCACCACACCUGGCUAAU | 3129 |
| UUAGCCAGGUGUGGUGGUG | 3130 | CACCACCACACCUGGCUAA | 3131 |
| GUGCGCACCUGUAGUCCCA | 3132 | UGGGACUACAGGUGCGCAC | 3133 |
| UGCGCACCUGUAGUCCCAA | 3134 | UUGGGACUACAGGUGCGCA | 3135 |
| GCGCACCUGUAGUCCCAAC | 3136 | GUUGGGACUACAGGUGCGC | 3137 |
| CGCACCUGUAGUCCCAACU | 3138 | AGUUGGGACUACAGGUGCG | 3139 |
| UACUAAGGAGGCUGAGGCA | 3140 | UGCCUCAGCCUCCUUAGUA | 3141 |
| ACUAAGGAGGCUGAGGCAG | 3142 | CUGCCUCAGCCUCCUUAGU | 3143 |
| UUCAAGGCUGCAGUGAGCU | 3144 | AGCUCACUGCAGCCUUGAA | 3145 |
| UCAAGGCUGCAGUGAGCUA | 3146 | UAGCUCACUGCAGCCUUGA | 3147 |
| CAAGGCUGCAGUGAGCUAU | 3148 | AUAGCUCACUGCAGCCUUG | 3149 |
| AAGGCUGCAGUGAGCUAUG | 3150 | CAUAGCUCACUGCAGCCUU | 3151 |
| UGCAGUGAGCUAUGAUUGU | 3152 | ACAAUCAUAGCUCACUGCA | 3153 |
| GCAGUGAGCUAUGAUUGUG | 3154 | CACAAUCAUAGCUCACUGC | 3155 |
| CAGUGAGCUAUGAUUGUGC | 3156 | GCACAAUCAUAGCUCACUG | 3157 |
| GGAGGCCUGGCACUACUUC | 3158 | GAAGUAGUGCCAGGCCUCC | 3159 |
| GAGGCCUGGCACUACUUCU | 3160 | AGAAGUAGUGCCAGGCCUC | 3161 |
| AGGCCUGGCACUACUUCUA | 3162 | UAGAAGUAGUGCCAGGCCU | 3163 |
| GGCCUGGCACUACUUCUAG | 3164 | CUAGAAGUAGUGCCAGGCC | 3165 |
| GCCUGGCACUACUUCUAGG | 3166 | CCUAGAAGUAGUGCCAGGC | 3167 |
| CCUGGCACUACUUCUAGGA | 3168 | UCCUAGAAGUAGUGCCAGG | 3169 |
| CUGGCACUACUUCUAGGAU | 3170 | AUCCUAGAAGUAGUGCCAG | 3171 |
| UGGCACUACUUCUAGGAUG | 3172 | CAUCCUAGAAGUAGUGCCA | 3173 |
| AAUUUAGGCAACUCUCACA | 3174 | UGUGAGAGUUGCCUAAAUU | 3175 |
| AUUUAGGCAACUCUCACAG | 3176 | CUGUGAGAGUUGCCUAAAU | 3177 |
| UUUAGGCAACUCUCACAGU | 3178 | ACUGUGAGAGUUGCCUAAA | 3179 |
| UUAGGCAACUCUCACAGUC | 3180 | GACUGUGAGAGUUGCCUAA | 3181 |
| UAGGCAACUCUCACAGUCC | 3182 | GGACUGUGAGAGUUGCCUA | 3183 |
| AGGCAACUCUCACAGUCCC | 3184 | GGGACUGUGAGAGUUGCCU | 3185 |
| GGCAACUCUCACAGUCCCU | 3186 | AGGGACUGUGAGAGUUGCC | 3187 |
| GCAACUCUCACAGUCCCUU | 3188 | AAGGGACUGUGAGAGUUGC | 3189 |
| CAACUCUCACAGUCCCUUG | 3190 | CAAGGGACUGUGAGAGUUG | 3191 |
| AACUCUCACAGUCCCUUGA | 3192 | UCAAGGGACUGUGAGAGUU | 3193 |
| ACUCUCACAGUCCCUUGAA | 3194 | UUCAAGGGACUGUGAGAGU | 3195 |
| AGAAGUGGCAGCUGGGUAU | 3196 | AUACCCAGCUGCCACUUCU | 3197 |
| GAAGUGGCAGCUGGGUAUA | 3198 | UAUACCCAGCUGCCACUUC | 3199 |
| AAGUGGCAGCUGGGUAUAG | 3200 | CUAUACCCAGCUGCCACUU | 3201 |
| AGUGGCAGCUGGGUAUAGG | 3202 | CCUAUACCCAGCUGCCACU | 3203 |
| GUGGCAGCUGGGUAUAGGC | 3204 | GCCUAUACCCAGCUGCCAC | 3205 |
| UGGCAGCUGGGUAUAGGCC | 3206 | GGCCUAUACCCAGCUGCCA | 3207 |
| GCAGCUGGGUAUAGGCCCU | 3208 | AGGGCCUAUACCCAGCUGC | 3209 |
| CAGCUGGGUAUAGGCCCUC | 3210 | GAGGGCCUAUACCCAGCUG | 3211 |
| AGCUGGGUAUAGGCCCUCC | 3212 | GGAGGGCCUAUACCCAGCU | 3213 |

TABLE 4-continued

| Sense Sequence | SEQ ID NO: | Antisense Sequence | SEQ ID NO: |
|---|---|---|---|
| GGUAUAGGCCCUCCCAAGU | 3214 | ACUUGGGAGGGCCUAUACC | 3215 |
| GUAUAGGCCCUCCCAAGUG | 3216 | CACUUGGGAGGGCCUAUAC | 3217 |
| UAUAGGCCCUCCCAAGUGU | 3218 | ACACUUGGGAGGGCCUAUA | 3219 |
| AUAGGCCCUCCCAAGUGUC | 3220 | GACACUUGGGAGGGCCUAU | 3221 |
| UAGGCCCUCCCAAGUGUCA | 3222 | UGACACUUGGGAGGGCCUA | 3223 |
| CCCUCCCAAGUGUCAUGCC | 3224 | GGCAUGACACUUGGGAGGG | 3225 |
| CCUCCCAAGUGUCAUGCCC | 3226 | GGGCAUGACACUUGGGAGG | 3227 |
| CCCUGACAGUCCUGAUGGA | 3228 | UCCAUCAGGACUGUCAGGG | 3229 |
| CUGAUGGACUCUGCCCUGU | 3230 | ACAGGGCAGAGUCCAUCAG | 3231 |
| UGAUGGACUCUGCCCUGUG | 3232 | CACAGGGCAGAGUCCAUCA | 3233 |
| UGGACUCUGCCCUGUGUAA | 3234 | UUACACAGGGCAGAGUCCA | 3235 |
| GGACUCUGCCCUGUGUAAG | 3236 | CUUACACAGGGCAGAGUCC | 3237 |
| GACUCUGCCCUGUGUAAGA | 3238 | UCUUACACAGGGCAGAGUC | 3239 |
| CUGCCCUGUGUAAGAUUGC | 3240 | GCAAUCUUACACAGGGCAG | 3241 |
| UGCCCUGUGUAAGAUUGCA | 3242 | UGCAAUCUUACACAGGGCA | 3243 |
| GCCCUGUGUAAGAUUGCAU | 3244 | AUGCAAUCUUACACAGGGC | 3245 |
| CCCUGUGUAAGAUUGCAUC | 3246 | GAUGCAAUCUUACACAGGG | 3247 |
| CUGUGUAAGAUUGCAUCAC | 3248 | GUGAUGCAAUCUUACACAG | 3249 |
| UGUGUAAGAUUGCAUCACC | 3250 | GGUGAUGCAAUCUUACACA | 3251 |
| GUGUAAGAUUGCAUCACCA | 3252 | UGGUGAUGCAAUCUUACAC | 3253 |
| UGUAAGAUUGCAUCACCAC | 3254 | GUGGUGAUGCAAUCUUACA | 3255 |
| CACCACCACCACCACCUCU | 3256 | AGAGGUGGUGGUGGUGGUG | 3257 |
| ACCACCACCACCACCUCUC | 3258 | GAGAGGUGGUGGUGGUGGU | 3259 |
| CCACCACCACCACCUCUCU | 3260 | AGAGAGGUGGUGGUGGUGG | 3261 |
| CACCACCACCACCUCUCUG | 3262 | CAGAGAGGUGGUGGUGGUG | 3263 |
| ACCACCACCACCUCUCUGG | 3264 | CCAGAGAGGUGGUGGUGGU | 3265 |
| UGGCCCUCCUCCACAUCAU | 3266 | AUGAUGUGGAGGAGGGCCA | 3267 |
| GGCCCUCCUCCACAUCAUG | 3268 | CAUGAUGUGGAGGAGGGCC | 3269 |
| GCCCUCCUCCACAUCAUGC | 3270 | GCAUGAUGUGGAGGAGGGC | 3271 |
| CCCUCCUCCACAUCAUGCU | 3272 | AGCAUGAUGUGGAGGAGGG | 3273 |
| CCUCCUCCACAUCAUGCUC | 3274 | GAGCAUGAUGUGGAGGAGG | 3275 |
| CUCCUCCACAUCAUGCUCC | 3276 | GGAGCAUGAUGUGGAGGAG | 3277 |
| UCCUCCACAUCAUGCUCCA | 3278 | UGGAGCAUGAUGUGGAGGA | 3279 |
| CCUCCACAUCAUGCUCCAC | 3280 | GUGGAGCAUGAUGUGGAGG | 3281 |
| CUCCACAUCAUGCUCCACA | 3282 | UGUGGAGCAUGAUGUGGAG | 3283 |
| ACAUCAUGCUCCACAUCAU | 3284 | AUGAUGUGGAGCAUGAUGU | 3285 |
| AUGCUCCACAUCAUGCUCC | 3286 | GGAGCAUGAUGUGGAGCAU | 3287 |
| GCUCCACAUCAUGCUCCAG | 3288 | CUGGAGCAUGAUGUGGAGC | 3289 |
| CUCCACAUCAUGCUCCAGG | 3290 | CCUGGAGCAUGAUGUGGAG | 3291 |
| UCCACAUCAUGCUCCAGGC | 3292 | GCCUGGAGCAUGAUGUGGA | 3293 |
| CCACAUCAUGCUCCAGGCC | 3294 | GGCCUGGAGCAUGAUGUGG | 3295 |
| CACAUCAUGCUCCAGGCCA | 3296 | UGGCCUGGAGCAUGAUGUG | 3297 |
| ACAUCAUGCUCCAGGCCAA | 3298 | UUGGCCUGGAGCAUGAUGU | 3299 |
| CAUCAUGCUCCAGGCCAAC | 3300 | GUUGGCCUGGAGCAUGAUG | 3301 |
| AUCAUGCUCCAGGCCAACU | 3302 | AGUUGGCCUGGAGCAUGAU | 3303 |
| UCAUGCUCCAGGCCAACUG | 3304 | CAGUUGGCCUGGAGCAUGA | 3305 |
| GUGACUUCUGUGCCUCGUG | 3306 | CACGAGGCACAGAAGUCAC | 3307 |
| UGACUUCUGUGCCUCGUGG | 3308 | CCACGAGGCACAGAAGUCA | 3309 |
| GACUUCUGUGCCUCGUGGC | 3310 | GCCACGAGGCACAGAAGUC | 3311 |
| CACCUGGGCCUGAGCAAGA | 3312 | UCUUGCUCAGGCCCAGGUG | 3313 |
| ACCUGGGCCUGAGCAAGAG | 3314 | CUCUUGCUCAGGCCCAGGU | 3315 |
| AGCAAGAGGGCUCCAUUCU | 3316 | AGAAUGGAGCCCUCUUGCU | 3317 |
| GCAAGAGGGCUCCAUUCUC | 3318 | GAGAAUGGAGCCCUCUUGC | 3319 |
| CAAGAGGGCUCCAUUCUCC | 3320 | GGAGAAUGGAGCCCUCUUG | 3321 |
| AGAGGGCUCCAUUCUCCUA | 3322 | UAGGAGAAUGGAGCCCUCU | 3323 |
| GAGGGCUCCAUUCUCCUAC | 3324 | GUAGGAGAAUGGAGCCCUC | 3325 |
| AGGGCUCCAUUCUCCUACC | 3326 | GGUAGGAGAAUGGAGCCCU | 3327 |
| GGGCUCCAUUCUCCUACCC | 3328 | GGGUAGGAGAAUGGAGCCC | 3329 |
| AACCCUCAUCCCUGUCCUA | 3330 | UAGGACAGGGAUGAGGGUU | 3331 |
| ACCCUCAUCCCUGUCCUAG | 3332 | CUAGGACAGGGAUGAGGGU | 3333 |
| CCCUCAUCCCUGUCCUAGC | 3334 | GCUAGGACAGGGAUGAGGG | 3335 |
| CCUCAUCCCUGUCCUAGCC | 3336 | GGCUAGGACAGGGAUGAGG | 3337 |
| GAAUUUCCUUCUGGCCUAA | 3338 | UAGGCCAGAAGGAAAAUUC | 3339 |
| AAUUUCCUUCUGGCCUAA | 3340 | UUAGGCCAGAAGGAAAAUU | 3341 |
| UGCUGCAGCAGUGGUGAAG | 3342 | CUUCACCACUGCUGCAGCA | 3343 |
| GCUGCAGCAGUGGUGAAGC | 3344 | GCUUCACCACUGCUGCAGC | 3345 |
| CUGCAGCAGUGGUGAAGCU | 3346 | AGCUUCACCACUGCUGCAG | 3347 |
| UGCAGCAGUGGUGAAGCUA | 3348 | UAGCUUCACCACUGCUGCA | 3349 |
| AAAGACUAGAGGUAUGAGG | 3350 | CCUCAUACCUCUAGUCUUU | 3351 |
| AAGACUAGAGGUAUGAGGG | 3352 | CCCUCAUACCUCUAGUCUU | 3353 |
| AGACUAGAGGUAUGAGGGA | 3354 | UCCCUCAUACCUCUAGUCU | 3355 |
| GACUAGAGGUAUGAGGGAA | 3356 | UUCCCUCAUACCUCUAGUC | 3357 |
| CCCACCUGGCUCAUAAGGC | 3358 | GCCUUAUGAGCCAGGUGGG | 3359 |
| CCACCUGGCUCAUAAGGCG | 3360 | CGCCUUAUGAGCCAGGUGG | 3361 |
| CACCUGGCUCAUAAGGCGU | 3362 | ACGCCUUAUGAGCCAGGUG | 3363 |
| ACCUGGCUCAUAAGGCGUU | 3364 | AACGCCUUAUGAGCCAGGU | 3365 |

TABLE 4-continued

| Sense Sequence | SEQ ID NO: | Antisense Sequence | SEQ ID NO: |
|---|---|---|---|
| CUGGCUCAUAAGGCGUUCC | 3366 | GGAACGCCUUAUGAGCCAG | 3367 |
| CUCAUAAGGCGUUCCCUCC | 3368 | GGAGGGAACGCCUUAUGAG | 3369 |
| UCAUAAGGCGUUCCCUCCC | 3370 | GGGAGGGAACGCCUUAUGA | 3371 |
| AAAUCAUCCUCUUUCUUGC | 3372 | GCAAGAAAGAGGAUGAUUU | 3373 |
| AAUCAUCCUCUUUCUUGCA | 3374 | UGCAAGAAAGAGGAUGAUU | 3375 |
| UCAUCCUCUUUCUUGCAUC | 3376 | GAUGCAAGAAAGAGGAUGA | 3377 |
| CAUCCUCUUUCUUGCAUCA | 3378 | UGAUGCAAGAAAGAGGAUG | 3379 |
| AUCCUCUUUCUUGCAUCAU | 3380 | AUGAUGCAAGAAAGAGGAU | 3381 |
| UCCUCUUUCUUGCAUCAUG | 3382 | CAUGAUGCAAGAAAGAGGA | 3383 |
| CUCUUUCUUGCAUCAUGCG | 3384 | CGCAUGAUGCAAGAAAGAG | 3385 |
| UCUUUCUUGCAUCAUGCGU | 3386 | ACGCAUGAUGCAAGAAAGA | 3387 |
| CUUUCUUGCAUCAUGCGUG | 3388 | CACGCAUGAUGCAAGAAAG | 3389 |
| UUUCUUGCAUCAUGCGUGU | 3390 | ACACGCAUGAUGCAAGAAA | 3391 |
| UUCUUGCAUCAUGCGUGUC | 3392 | GACACGCAUGAUGCAAGAA | 3393 |
| UCUUGCAUCAUGCGUGUCC | 3394 | GGACACGCAUGAUGCAAGA | 3395 |
| CUUGCAUCAUGCGUGUCCA | 3396 | UGGACACGCAUGAUGCAAG | 3397 |
| UCAUGCGUGUCCACAUUGC | 3398 | GCAAUGUGGACACGCAUGA | 3399 |
| CAUGCGUGUCCACAUUGCA | 3400 | UGCAAUGUGGACACGCAUG | 3401 |
| CCCUACUUCAGGCCCAGUC | 3402 | GACUGGGCCUGAAGUAGGG | 3403 |
| CCUACUUCAGGCCCAGUCA | 3404 | UGACUGGGCCUGAAGUAGG | 3405 |
| UUCAGGCCCAGUCACCAUG | 3406 | CAUGGUGACUGGGCCUGAA | 3407 |
| UCAGGCCCAGUCACCAUGG | 3408 | CCAUGGUGACUGGGCCUGA | 3409 |
| CCAGUCACCAUGGCCAGAU | 3410 | AUCUGGCCAUGGUGACUGG | 3411 |
| CAGUCACCAUGGCCAGAUG | 3412 | CAUCUGGCCAUGGUGACUG | 3413 |
| AGCACAGCUGGCCAAUCCU | 3414 | AGGAUUGGCCAGCUGUGCU | 3415 |
| GCACAGCUGGCCAAUCCUG | 3416 | CAGGAUUGGCCAGCUGUGC | 3417 |
| AGCUGGCCAAUCCUGGGAC | 3418 | GUCCCAGGAUUGGCCAGCU | 3419 |
| GCUGGCCAAUCCUGGGACU | 3420 | AGUCCCAGGAUUGGCCAGC | 3421 |
| CUGGCCAAUCCUGGGACUC | 3422 | GAGUCCCAGGAUUGGCCAG | 3423 |
| UGGCCAAUCCUGGGACUCA | 3424 | UGAGUCCCAGGAUUGGCCA | 3425 |
| AUCCUGGGACUCAGAGGGU | 3426 | ACCCUCUGAGUCCCAGGAU | 3427 |
| UCCUGGGACUCAGAGGGUA | 3428 | UACCCUCUGAGUCCCAGGA | 3429 |
| CCUGGGACUCAGAGGGUAG | 3430 | CUACCCUCUGAGUCCCAGG | 3431 |
| CUGGGACUCAGAGGGUAGG | 3432 | CCUACCCUCUGAGUCCCAG | 3433 |
| GGACUCAGAGGGUAGGUCG | 3434 | CGACCUACCCUCUGAGUCC | 3435 |
| GACUCAGAGGGUAGGUCGG | 3436 | CCGACCUACCCUCUGAGUC | 3437 |
| ACUCAGAGGGUAGGUCGGC | 3438 | GCCGACCUACCCUCUGAGU | 3439 |
| CUCAGAGGGUAGGUCGGCU | 3440 | AGCCGACCUACCCUCUGAG | 3441 |
| UCAGAGGGUAGGUCGGCUG | 3442 | CAGCCGACCUACCCUCUGA | 3443 |
| GGCUGGCUGACCACUAGGU | 3444 | ACCUAGUGGUCAGCCAGCC | 3445 |
| GCUGGCUGACCACUAGGUU | 3446 | AACCUAGUGGUCAGCCAGC | 3447 |
| CUGGCUGACCACUAGGUUU | 3448 | AAACCUAGUGGUCAGCCAG | 3449 |
| CUGACCACUAGGUUUGGAA | 3450 | UUCCAAACCUAGUGGUCAG | 3451 |
| UGACCACUAGGUUUGGAAG | 3452 | CUUCCAAACCUAGUGGUCA | 3453 |
| GACCACUAGGUUUGGAAGA | 3454 | UCUUCCAAACCUAGUGGUC | 3455 |
| ACCACUAGGUUUGGAAGAC | 3456 | GUCUUCCAAACCUAGUGGU | 3457 |
| CCACUAGGUUUGGAAGACC | 3458 | GGUCUUCCAAACCUAGUGG | 3459 |
| UAGGUUUGGAAGACCCAGG | 3460 | CCUGGGUCUUCCAAACCUA | 3461 |
| AGGUUUGGAAGACCCAGGC | 3462 | GCCUGGGUCUUCCAAACCU | 3463 |
| CAGGCAGCUGGCUCUAAAG | 3464 | CUUUAGAGCCAGCUGCCUG | 3465 |
| AGGCAGCUGGCUCUAAAGA | 3466 | UCUUUAGAGCCAGCUGCCU | 3467 |
| AGCUGGCUCUAAAGAGGCC | 3468 | GGCCUCUUUAGAGCCAGCU | 3469 |
| GCUGGCUCUAAAGAGGCCC | 3470 | GGGCCUCUUUAGAGCCAGC | 3471 |
| CCAGGUCAGUAGCCAGACA | 3472 | UGUCUGGCUACUGACCUGG | 3473 |
| GUCAGUAGCCAGACAUGAG | 3474 | CUCAUGUCUGGCUACUGAC | 3475 |
| GUAGCCAGACAUGAGCUGU | 3476 | ACAGCUCAUGUCUGGCUAC | 3477 |
| AGACAUGAGCUGUGAGGGU | 3478 | ACCCUCACAGCUCAUGUCU | 3479 |
| AUGAGCUGUGAGGGUCAAG | 3480 | CUUGACCCUCACAGCUCAU | 3481 |
| UGAGCUGUGAGGGUCAAGC | 3482 | GCUUGACCCUCACAGCUCA | 3483 |
| GAGCUGUGAGGGUCAAGCA | 3484 | UGCUUGACCCUCACAGCUC | 3485 |
| AGCUGUGAGGGUCAAGCAC | 3486 | GUGCUUGACCCUCACAGCU | 3487 |
| GUGAGGGUCAAGCACAGCU | 3488 | AGCUGUGCUUGACCCUCAC | 3489 |
| UGAGGGUCAAGCACAGCUA | 3490 | UAGCUGUGCUUGACCCUCA | 3491 |
| GAGGGUCAAGCACAGCUAU | 3492 | AUAGCUGUGCUUGACCCUC | 3493 |
| AGGGUCAAGCACAGCUAUC | 3494 | GAUAGCUGUGCUUGACCCU | 3495 |
| GGGUCAAGCACAGCUAUCC | 3496 | GGAUAGCUGUGCUUGACCC | 3497 |
| CAAGCACAGCUAUCCAUCA | 3498 | UGAUGGAUAGCUGUGCUUG | 3499 |
| CACAGCUAUCCAUCAGAUG | 3500 | CAUCUGAUGGAUAGCUGUG | 3501 |
| ACAGCUAUCCAUCAGAUGA | 3502 | UCAUCUGAUGGAUAGCUGU | 3503 |
| CAGCUAUCCAUCAGAUGAU | 3504 | AUCAUCUGAUGGAUAGCUG | 3505 |
| AGCUAUCCAUCAGAUGAUC | 3506 | GAUCAUCUGAUGGAUAGCU | 3507 |
| GCUAUCCAUCAGAUGAUCU | 3508 | AGAUCAUCUGAUGGAUAGC | 3509 |
| CUAUCCAUCAGAUGAUCUA | 3510 | UAGAUCAUCUGAUGGAUAG | 3511 |
| CAUCAGAUGAUCUACUUUC | 3512 | GAAAGUAGAUCAUCUGAUG | 3513 |
| AGAUGAUCUACUUUCAGCC | 3514 | GGCUGAAAGUAGAUCAUCU | 3515 |
| GAUCUACUUUCAGCCUUCC | 3516 | GGAAGGCUGAAAGUAGAUC | 3517 |

TABLE 4-continued

| Sense Sequence | SEQ ID NO: | Antisense Sequence | SEQ ID NO: |
|---|---|---|---|
| AUCUACUUUCAGCCUUCCU | 3518 | AGGAAGGCUGAAAGUAGAU | 3519 |
| CAAUAGAAGACAGGUGGCU | 3520 | AGCCACCUGUCUUCUAUUG | 3521 |
| AAUAGAAGACAGGUGGCUG | 3522 | CAGCCACCUGUCUUCUAUU | 3523 |
| CAGGUGGCUGUACCCUUGG | 3524 | CCAAGGGUACAGCCACCUG | 3525 |
| AGGUGGCUGUACCCUUGGC | 3526 | GCCAAGGGUACAGCCACCU | 3527 |
| GGCUGUACCCUUGGCCAAG | 3528 | CUUGGCCAAGGGUACAGCC | 3529 |
| UGGUGUCUGCUGUCACUGU | 3530 | ACAGUGACAGCAGACACCA | 3531 |
| GUCUGCUGUCACUGUGCCC | 3532 | GGGCACAGUGACAGCAGAC | 3533 |
| CUGCUGUCACUGUGCCCUC | 3534 | GAGGGCACAGUGACAGCAG | 3535 |
| UGCUGUCACUGUGCCCUCA | 3536 | UGAGGGCACAGUGACAGCA | 3537 |
| GCUGUCACUGUGCCCUCAU | 3538 | AUGAGGGCACAGUGACAGC | 3539 |
| CUGUCACUGUGCCCUCAUU | 3540 | AAUGAGGGCACAGUGACAG | 3541 |
| UGUCACUGUGCCCUCAUUG | 3542 | CAAUGAGGGCACAGUGACA | 3543 |
| GUCACUGUGCCCUCAUUGG | 3544 | CCAAUGAGGGCACAGUGAC | 3545 |
| ACUGUGCCCUCAUUGGCCC | 3546 | GGGCCAAUGAGGGCACAGU | 3547 |
| CCCAGCAAUCAGACUCAAC | 3548 | GUUGAGUCUGAUUGCUGGG | 3549 |
| GGAGCAACUGCCAUCCGAG | 3550 | CUCGGAUGGCAGUUGCUCC | 3551 |
| GAGCAACUGCCAUCCGAGG | 3552 | CCUCGGAUGGCAGUUGCUC | 3553 |
| AGCAACUGCCAUCCGAGGC | 3554 | GCCUCGGAUGGCAGUUGCU | 3555 |
| GCAACUGCCAUCCGAGGCU | 3556 | AGCCUCGGAUGGCAGUUGC | 3557 |
| CAACUGCCAUCCGAGGCUC | 3558 | GAGCCUCGGAUGGCAGUUG | 3559 |
| GCCAUCCGAGGCUCCUGAA | 3560 | UUCAGGAGCCUCGGAUGGC | 3561 |
| AACCAGGGCCAUUCACCAG | 3562 | CUGGUGAAUGGCCCUGGUU | 3563 |
| ACCAGGGCCAUUCACCAGG | 3564 | CCUGGUGAAUGGCCCUGGU | 3565 |
| CCAGGGCCAUUCACCAGGA | 3566 | UCCUGGUGAAUGGCCCUGG | 3567 |
| CAGGGCCAUUCACCAGGAG | 3568 | CUCCUGGUGAAUGGCCCUG | 3569 |
| GGCCAUUCACCAGGAGCAU | 3570 | AUGCUCCUGGUGAAUGGCC | 3571 |
| GCCAUUCACCAGGAGCAUG | 3572 | CAUGCUCCUGGUGAAUGGC | 3573 |
| CCAUUCACCAGGAGCAUGC | 3574 | GCAUGCUCCUGGUGAAUGG | 3575 |
| CAUUCACCAGGAGCAUGCG | 3576 | CGCAUGCUCCUGGUGAAUG | 3577 |
| AUUCACCAGGAGCAUGCGG | 3578 | CCGCAUGCUCCUGGUGAAU | 3579 |
| UUCACCAGGAGCAUGCGGC | 3580 | GCCGCAUGCUCCUGGUGAA | 3581 |
| UCACCAGGAGCAUGCGGCU | 3582 | AGCCGCAUGCUCCUGGUGA | 3583 |
| AGCAUGCGGCUCCCUGAUG | 3584 | CAUCAGGGAGCCGCAUGCU | 3585 |
| GCAUGCGGCUCCCUGAUGU | 3586 | ACAUCAGGGAGCCGCAUGC | 3587 |
| CAUGCGGCUCCCUGAUGUC | 3588 | GACAUCAGGGAGCCGCAUG | 3589 |
| AUGCGGCUCCCUGAUGUCC | 3590 | GGACAUCAGGGAGCCGCAU | 3591 |
| UGCGGCUCCCUGAUGUCCA | 3592 | UGGACAUCAGGGAGCCGCA | 3593 |
| GCUCCCUGAUGUCCAGCUC | 3594 | GAGCUGGACAUCAGGGAGC | 3595 |
| CUCCCUGAUGUCCAGCUCU | 3596 | AGAGCUGGACAUCAGGGAG | 3597 |
| UCCCUGAUGUCCAGCUCUG | 3598 | CAGAGCUGGACAUCAGGGA | 3599 |
| CCCUGAUGUCCAGCUCUGG | 3600 | CCAGAGCUGGACAUCAGGG | 3601 |
| CCUGAUGUCCAGCUCUGGC | 3602 | GCCAGAGCUGGACAUCAGG | 3603 |
| CUGAUGUCCAGCUCUGGCU | 3604 | AGCCAGAGCUGGACAUCAG | 3605 |
| UCUGGUGCUGGAGCUAGCC | 3606 | GGCUAGCUCCAGCACCAGA | 3607 |
| UGGUGCUGGAGCUAGCCAA | 3608 | UUGGCUAGCUCCAGCACCA | 3609 |
| GGUGCUGGAGCUAGCCAAG | 3610 | CUUGGCUAGCUCCAGCACC | 3611 |
| GUGCUGGAGCUAGCCAAGC | 3612 | GCUUGGCUAGCUCCAGCAC | 3613 |
| GCUGGAGCUAGCCAAGCAG | 3614 | CUGCUUGGCUAGCUCCAGC | 3615 |
| CUGGAGCUAGCCAAGCAGC | 3616 | GCUGCUUGGCUAGCUCCAG | 3617 |
| UGGAGCUAGCCAAGCAGCA | 3618 | UGCUGCUUGGCUAGCUCCA | 3619 |
| GGAGCUAGCCAAGCAGCAA | 3620 | UUGCUGCUUGGCUAGCUCC | 3621 |
| GAGCUAGCCAAGCAGCAAA | 3622 | UUUGCUGCUUGGCUAGCUC | 3623 |
| AGCUAGCCAAGCAGCAAAU | 3624 | AUUUGCUGCUUGGCUAGCU | 3625 |
| GCUAGCCAAGCAGCAAAUC | 3626 | GAUUUGCUGCUUGGCUAGC | 3627 |
| CAGCAAAUCCUGGAUGGGU | 3628 | ACCCAUCCAGGAUUUGCUG | 3629 |
| AGCAAAUCCUGGAUGGGUU | 3630 | AACCCAUCCAGGAUUUGCU | 3631 |
| GCAAAUCCUGGAUGGGUUG | 3632 | CAACCCAUCCAGGAUUUGC | 3633 |
| CAAAUCCUGGAUGGGUUGC | 3634 | GCAACCCAUCCAGGAUUUG | 3635 |
| AAAUCCUGGAUGGGUUGCA | 3636 | UGCAACCCAUCCAGGAUUU | 3637 |
| GGUUGCACCUGACCAGUCG | 3638 | CGACUGGUCAGGUGCAACC | 3639 |
| GUUGCACCUGACCAGUCGU | 3640 | ACGACUGGUCAGGUGCAAC | 3641 |
| UUGCACCUGACCAGUCGUC | 3642 | GACGACUGGUCAGGUGCAA | 3643 |
| UGCACCUGACCAGUCGUCC | 3644 | GGACGACUGGUCAGGUGCA | 3645 |
| UGACCAGUCGUCCCAGAAU | 3646 | AUUCUGGGACGACUGGUCA | 3647 |
| GACCAGUCGUCCCAGAAUA | 3648 | UAUUCUGGGACGACUGGUC | 3649 |
| ACCAGUCGUCCCAGAAUAA | 3650 | UUAUUCUGGGACGACUGGU | 3651 |
| CCAGUCGUCCCAGAAUAAC | 3652 | GUUAUUCUGGGACGACUGG | 3653 |
| CAGUCGUCCCAGAAUAACU | 3654 | AGUUAUUCUGGGACGACUG | 3655 |
| AGUCGUCCCAGAAUAACUC | 3656 | GAGUUAUUCUGGGACGACU | 3657 |
| GUCGUCCCAGAAUAACUCA | 3658 | UGAGUUAUUCUGGGACGAC | 3659 |
| UCGUCCCAGAAUAACUCAU | 3660 | AUGAGUUAUUCUGGGACGA | 3661 |
| CGUCCCAGAAUAACUCAUC | 3662 | GAUGAGUUAUUCUGGGACG | 3663 |
| GUCCCAGAAUAACUCAUCC | 3664 | GGAUGAGUUAUUCUGGGAC | 3665 |
| UCCCAGAAUAACUCAUCCU | 3666 | AGGAUGAGUUAUUCUGGGA | 3667 |
| CCCAGAAUAACUCAUCCUC | 3668 | GAGGAUGAGUUAUUCUGGG | 3669 |

TABLE 4-continued

| Sense Sequence | SEQ ID NO: | Antisense Sequence | SEQ ID NO: |
|---|---|---|---|
| GACUACAGCCAGGGAGUGU | 3670 | ACACUCCCUGGCUGUAGUC | 3671 |
| ACUACAGCCAGGGAGUGUG | 3672 | CACACUCCCUGGCUGUAGU | 3673 |
| CUACAGCCAGGGAGUGUGG | 3674 | CCACACUCCCUGGCUGUAG | 3675 |
| GAGUGUGGCUCCAGGGAAU | 3676 | AUUCCCUGGAGCCACACUC | 3677 |
| GGGAGGAGGUCAUCAGCUU | 3678 | AAGCUGAUGACCUCCUCCC | 3679 |
| GAGGUCAUCAGCUUUGCUA | 3680 | UAGCAAAGCUGAUGACCUC | 3681 |
| AGGUCAUCAGCUUUGCUAC | 3682 | GUAGCAAAGCUGAUGACCU | 3683 |
| GGUCAUCAGCUUUGCUACU | 3684 | AGUAGCAAAGCUGAUGACC | 3685 |
| GCUUUGCUACUGUCACAGG | 3686 | CCUGUGACAGUAGCAAAGC | 3687 |
| CUUUGCUACUGUCACAGGU | 3688 | ACCUGUGACAGUAGCAAAG | 3689 |
| UUUGCUACUGUCACAGGUG | 3690 | CACCUGUGACAGUAGCAAA | 3691 |
| UUGCUACUGUCACAGGUGG | 3692 | CCACCUGUGACAGUAGCAA | 3693 |
| UGCUACUGUCACAGGUGGG | 3694 | CCCACCUGUGACAGUAGCA | 3695 |
| GCUACUGUCACAGGUGGGU | 3696 | ACCCACCUGUGACAGUAGC | 3697 |
| CUACUGUCACAGGUGGGUG | 3698 | CACCCACCUGUGACAGUAG | 3699 |
| CAGGCAAAGAGCAGACAGG | 3700 | CCUGUCUGCUCUUUGCCUG | 3701 |
| GGCAGGGACUGGUUGCAGA | 3702 | UCUGCAACCAGUCCCUGCC | 3703 |
| GCAGGGACUGGUUGCAGAG | 3704 | CUCUGCAACCAGUCCCUGC | 3705 |
| AGGGACUGGUUGCAGAGGA | 3706 | UCCUCUGCAACCAGUCCCU | 3707 |
| GGGACUGGUUGCAGAGGAC | 3708 | GUCCUCUGCAACCAGUCCC | 3709 |
| GGACUGGUUGCAGAGGACA | 3710 | UGUCCUCUGCAACCAGUCC | 3711 |
| GACUGGUUGCAGAGGACAC | 3712 | GUGUCCUCUGCAACCAGUC | 3713 |
| UUUUCUAGAGGUAGGUUCG | 3714 | CGAACCUACCUCUAGAAAA | 3715 |
| UUUCUAGAGGUAGGUUCGA | 3716 | UCGAACCUACCUCUAGAAA | 3717 |
| UUCUAGAGGUAGGUUCGAG | 3718 | CUCGAACCUACCUCUAGAA | 3719 |
| UCUAGAGGUAGGUUCGAGG | 3720 | CCUCGAACCUACCUCUAGA | 3721 |
| CUAGAGGUAGGUUCGAGGG | 3722 | CCCUCGAACCUACCUCUAG | 3723 |
| UAGAGGUAGGUUCGAGGGA | 3724 | UCCCUCGAACCUACCUCUA | 3725 |
| GAGCUUCAUCUCUACUCAC | 3726 | GUGAGUAGAGAUGAAGCUC | 3727 |
| AGCUUCAUCUCUACUCACA | 3728 | UGUGAGUAGAGAUGAAGCU | 3729 |
| GCUUCAUCUCUACUCACAU | 3730 | AUGUGAGUAGAGAUGAAGC | 3731 |
| CUUCAUCUCUACUCACAUU | 3732 | AAUGUGAGUAGAGAUGAAG | 3733 |
| AUCUCUACUCACAUUUUCU | 3734 | AGAAAAUGUGAGUAGAGAU | 3735 |
| UCUCUACUCACAUUUUCUU | 3736 | AAGAAAAUGUGAGUAGAGA | 3737 |
| UCACAUUUCUUUCCCUUU | 3738 | AAAGGGAAAGAAAAUGUGA | 3739 |
| CCCUUUUCUGUCUUUCGGG | 3740 | CCCGAAAGACAGAAAAGGG | 3741 |
| CCUUUUCUGUCUUUCGGGC | 3742 | GCCCGAAAGACAGAAAAGG | 3743 |
| CUUUUCUGUCUUUCGGGCA | 3744 | UGCCCGAAAGACAGAAAAG | 3745 |
| UUUCGGGCAGACUCCACUU | 3746 | AAGUGGAGUCUGCCCGAAA | 3747 |
| UUCGGGCAGACUCCACUU | 3748 | GAAGUGGAGUCUGCCCGAA | 3749 |
| UCGGGCAGACUCCACUUCA | 3750 | UGAAGUGGAGUCUGCCCGA | 3751 |
| CGGGCAGACUCCACUUCAG | 3752 | CUGAAGUGGAGUCUGCCCG | 3753 |
| GGGCAGACUCCACUUCAGC | 3754 | GCUGAAGUGGAGUCUGCCC | 3755 |
| GGCAGACUCCACUUCAGCC | 3756 | GGCUGAAGUGGAGUCUGCC | 3757 |
| UCCACUUCAGCCUACAGCU | 3758 | AGCUGUAGGCUGAAGUGGA | 3759 |
| CCACUUCAGCCUACAGCUC | 3760 | GAGCUGUAGGCUGAAGUGG | 3761 |
| CACUUCAGCCUACAGCUCC | 3762 | GGAGCUGUAGGCUGAAGUG | 3763 |
| ACUUCAGCCUACAGCUCCC | 3764 | GGGAGCUGUAGGCUGAAGU | 3765 |
| CCUACAGCUCCCUGCUCAC | 3766 | GUGAGCAGGGAGCUGUAGG | 3767 |
| CUACAGCUCCCUGCUCACU | 3768 | AGUGAGCAGGGAGCUGUAG | 3769 |
| UACAGCUCCCUGCUCACUU | 3770 | AAGUGAGCAGGGAGCUGUA | 3771 |
| GCUCCCUGCUCACUUUUCA | 3772 | UGAAAAGUGAGCAGGGAGC | 3773 |
| CUCCCUGCUCACUUUUCAC | 3774 | GUGAAAAGUGAGCAGGGAG | 3775 |
| GCUCACUUUUCACCUGUCC | 3776 | GGACAGGUGAAAAGUGAGC | 3777 |
| CUCACUUUUCACCUGUCCA | 3778 | UGGACAGGUGAAAAGUGAG | 3779 |
| UGUCCACUCCUCGGUCCCA | 3780 | UGGGACCGAGGAGUGGACA | 3781 |
| UCGGUCCCACCACCUGUAC | 3782 | GUACAGGUGGUGGGACCGA | 3783 |
| CCACCACCUGUACCAUGCC | 3784 | GGCAUGGUACAGGUGGUGG | 3785 |
| CACCACCUGUACCAUGCCC | 3786 | GGGCAUGGUACAGGUGGUG | 3787 |
| ACCACCUGUACCAUGCCCG | 3788 | CGGGCAUGGUACAGGUGGU | 3789 |
| CACCCUUCCUGGCACUCUU | 3790 | AAGAGUGCCAGGAAGGGUG | 3791 |
| ACCCUUCCUGGCACUCUUU | 3792 | AAAGAGUGCCAGGAAGGGU | 3793 |
| CCCUUCCUGGCACUCUUUG | 3794 | CAAAGAGUGCCAGGAAGGG | 3795 |
| CCUUCCUGGCACUCUUUGC | 3796 | GCAAAGAGUGCCAGGAAGG | 3797 |
| UUCCUGGCACUCUUUGCUU | 3798 | AAGCAAAGAGUGCCAGGAA | 3799 |
| UCCUGGCACUCUUUGCUUG | 3800 | CAAGCAAAGAGUGCCAGGA | 3801 |
| CCUGGCACUCUUUGCUUGA | 3802 | UCAAGCAAAGAGUGCCAGG | 3803 |
| CUGGCACUCUUUGCUUGAG | 3804 | CUCAAGCAAAGAGUGCCAG | 3805 |
| UGGCACUCUUUGCUUGAGG | 3806 | CCUCAAGCAAAGAGUGCCA | 3807 |
| GGCACUCUUUGCUUGAGGA | 3808 | UCCUCAAGCAAAGAGUGCC | 3809 |
| GCACUCUUUGCUUGAGGAU | 3810 | AUCCUCAAGCAAAGAGUGC | 3811 |
| CACUCUUUGCUUGAGGAUC | 3812 | GAUCCUCAAGCAAAGAGUG | 3813 |
| ACUCUUUGCUUGAGGAUCU | 3814 | AGAUCCUCAAGCAAAGAGU | 3815 |
| CUCUUUGCUUGAGGAUCUU | 3816 | AAGAUCCUCAAGCAAAGAG | 3817 |
| UCUUUGCUUGAGGAUCUUC | 3818 | GAAGAUCCUCAAGCAAAGA | 3819 |
| UGCUUGAGGAUCUUCCGAU | 3820 | AUCGGAAGAUCCUCAAGCA | 3821 |

TABLE 4-continued

| Sense Sequence | SEQ ID NO: | Antisense Sequence | SEQ ID NO: |
|---|---|---|---|
| GCUUGAGGAUCUUCCGAUG | 3822 | CAUCGGAAGAUCCUCAAGC | 3823 |
| GCACUCUCCUGGCUGAGCA | 3824 | UGCUCAGCCAGGAGAGUGC | 3825 |
| CUCCUGGCUGAGCACCACA | 3826 | UGUGGUGCUCAGCCAGGAG | 3827 |
| UGGCUGAGCACCACAUCAC | 3828 | GUGAUGUGGUGCUCAGCCA | 3829 |
| GGCUGAGCACCACAUCACC | 3830 | GGUGAUGUGGUGCUCAGCC | 3831 |
| GCUGAGCACCACAUCACCA | 3832 | UGGUGAUGUGGUGCUCAGC | 3833 |
| CUGAGCACCACAUCACCAA | 3834 | UUGGUGAUGUGGUGCUCAG | 3835 |
| CCAACCUGGGCUGGCAUAC | 3836 | GUAUGCCAGCCCAGGUUGG | 3837 |
| CAACCUGGGCUGGCAUACC | 3838 | GGUAUGCCAGCCCAGGUUG | 3839 |
| AACCUGGGCUGGCAUACCU | 3840 | AGGUAUGCCAGCCCAGGUU | 3841 |
| ACCUGGGCUGGCAUACCUU | 3842 | AAGGUAUGCCAGCCCAGGU | 3843 |
| CCUGGGCUGGCAUACCUUA | 3844 | UAAGGUAUGCCAGCCCAGG | 3845 |
| CUGGGCUGGCAUACCUUAA | 3846 | UUAAGGUAUGCCAGCCCAG | 3847 |
| UGGGCUGGCAUACCUUAAC | 3848 | GUUAAGGUAUGCCAGCCCA | 3849 |
| GGGCUGGCAUACCUUAACU | 3850 | AGUUAAGGUAUGCCAGCCC | 3851 |
| GGCUGGCAUACCUUAACUC | 3852 | GAGUUAAGGUAUGCCAGCC | 3853 |
| GCUGGCAUACCUUAACUCU | 3854 | AGAGUUAAGGUAUGCCAGC | 3855 |
| CAUACCUUAACUCUGCCCU | 3856 | AGGGCAGAGUUAAGGUAUG | 3857 |
| AUACCUUAACUCUGCCCUC | 3858 | GAGGGCAGAGUUAAGGUAU | 3859 |
| UACCUUAACUCUGCCCUCU | 3860 | AGAGGGCAGAGUUAAGGUA | 3861 |
| UCUGCCCUCUAGUGGCUUG | 3862 | CAAGCCACUAGAGGGCAGA | 3863 |
| CUGCCCUCUAGUGGCUUGA | 3864 | UCAAGCCACUAGAGGGCAG | 3865 |
| UGCCCUCUAGUGGCUUGAG | 3866 | CUCAAGCCACUAGAGGGCA | 3867 |
| AGAAGUCUGGUGUCCUGAA | 3868 | UUCAGGCACCAGACUUCU | 3869 |
| CAGGACACCAGCAGCCCUU | 3870 | AAGGGCUGCUGGUGUCCUG | 3871 |
| AGGACACCAGCAGCCCUUC | 3872 | GAAGGGCUGCUGGUGUCCU | 3873 |
| ACACCAGCAGCCCUUCCUA | 3874 | UAGGAAGGGCUGCUGGUGU | 3875 |
| CACCAGCAGCCCUUCCUAG | 3876 | CUAGGAAGGGCUGCUGGUG | 3877 |
| ACCAGCAGCCCUUCCUAGA | 3878 | UCUAGGAAGGGCUGCUGGU | 3879 |
| CCAGCAGCCCUUCCUAGAG | 3880 | CUCUAGGAAGGGCUGCUGG | 3881 |
| CAGCAGCCCUUCCUAGAGC | 3882 | GCUCUAGGAAGGGCUGCUG | 3883 |
| AGCAGCCCUUCCUAGAGCU | 3884 | AGCUCUAGGAAGGGCUGCU | 3885 |
| GCCCUUCCUAGAGCUUAAG | 3886 | CUUAAGCUCUAGGAAGGGC | 3887 |
| CCCUUCCUAGAGCUUAAGA | 3888 | UCUUAAGCUCUAGGAAGGG | 3889 |
| AGCUUAAGAUCCGAGCCAA | 3890 | UUGGCUCGGAUCUUAAGCU | 3891 |
| GCUUAAGAUCCGAGCCAAU | 3892 | AUUGGCUCGGAUCUUAAGC | 3893 |
| CUUAAGAUCCGAGCCAAUG | 3894 | CAUUGGCUCGGAUCUUAAG | 3895 |
| UUAAGAUCCGAGCCAAUGA | 3896 | UCAUUGGCUCGGAUCUUAA | 3897 |
| UAAGAUCCGAGCCAAUGAG | 3898 | CUCAUUGGCUCGGAUCUUA | 3899 |
| CGAGCCAAUGAGCCUGGAG | 3900 | CUCCAGGCUCAUUGGCUCG | 3901 |
| CCCUUAUGUUGCAGGCGAG | 3902 | CUCGCCUGCAACAUAAGGG | 3903 |
| CAUUACGUAGACUUCCAGG | 3904 | CCUGGAAGUCUACGUAAUG | 3905 |
| AUUACGUAGACUUCCAGGA | 3906 | UCCUGGAAGUCUACGUAAU | 3907 |
| UUACGUAGACUUCCAGGAA | 3908 | UUCCUGGAAGUCUACGUAA | 3909 |
| ACUGGAUACUGCAGCCCGA | 3910 | UCGGGCUGCAGUAUCCAGU | 3911 |
| CUGGAUACUGCAGCCCGAG | 3912 | CUCGGGCUGCAGUAUCCAG | 3913 |
| UGGAUACUGCAGCCCGAGG | 3914 | CCUCGGGCUGCAGUAUCCA | 3915 |
| GGGUACCAGCUGAAUUACU | 3916 | AGUAAUUCAGCUGGUACCC | 3917 |
| CUGAAUUACUGCAGUGGGC | 3918 | GCCCACUGCAGUAAUUCAG | 3919 |
| UGAAUUACUGCAGUGGGCA | 3920 | UGCCCACUGCAGUAAUUCA | 3921 |
| UGGCAGCCCAGGCAUUGCU | 3922 | AGCAAUGCCUGGGCUGCCA | 3923 |
| GCAUUGCUGCCUCUUUCCA | 3924 | UGGAAAGAGGCAGCAAUGC | 3925 |
| CAUUGCUGCCUCUUUCCAU | 3926 | AUGGAAAGAGGCAGCAAUG | 3927 |
| AUUGCUGCCUCUUUCCAUU | 3928 | AAUGGAAAGAGGCAGCAAU | 3929 |
| UGCUGCCUCUUUCCAUUCU | 3930 | AGAAUGGAAAGAGGCAGCA | 3931 |
| GCUGCCUCUUUCCAUUCUG | 3932 | CAGAAUGGAAAGAGGCAGC | 3933 |
| CUGCCUCUUUCCAUUCUGC | 3934 | GCAGAAUGGAAAGAGGCAG | 3935 |
| UGCCUCUUUCCAUUCUGCC | 3936 | GGCAGAAUGGAAAGAGGCA | 3937 |
| GCCUCUUUCCAUUCUGCCG | 3938 | CGGCAGAAUGGAAAGAGGC | 3939 |
| CCUCUUUCCAUUCUGCCGU | 3940 | ACGGCAGAAUGGAAAGAGG | 3941 |
| CUCUUUCCAUUCUGCCGUC | 3942 | GACGGCAGAAUGGAAAGAG | 3943 |
| CAUUCUGCCGUCUUCAGCC | 3944 | GGCUGAAGACGGCAGAAUG | 3945 |
| CUUCAGCCUCCUCAAAGCC | 3946 | GGCUUUGAGGAGGCUGAAG | 3947 |
| UUCAGCCUCCUCAAAGCCA | 3948 | UGGCUUUGAGGAGGCUGAA | 3949 |
| UCAGCCUCCUCAAAGCCAA | 3950 | UUGGCUUUGAGGAGGCUGA | 3951 |
| CAGCCUCCUCAAAGCCAAC | 3952 | GUUGGCUUUGAGGAGGCUG | 3953 |
| UCCUUGGCUGCCAGUACC | 3954 | GGUACUGGCAGGCCAAGGA | 3955 |
| CCUGCCAGUACCUCCUGUU | 3956 | AACAGGAGGUACUGGCAGG | 3957 |
| CUGCCAGUACCUCCUGUUG | 3958 | CAACAGGAGGUACUGGCAG | 3959 |
| UGCCAGUACCUCCUGUUGU | 3960 | ACAACAGGAGGUACUGGCA | 3961 |
| GCCAGUACCUCCUGUUGUG | 3962 | CACAACAGGAGGUACUGGC | 3963 |
| CCAGUACCUCCUGUUGUGU | 3964 | ACACAACAGGAGGUACUGG | 3965 |
| CAGUACCUCCUGUUGUGUC | 3966 | GACACAACAGGAGGUACUG | 3967 |
| GUACCUCCUGUUGUGUCCC | 3968 | GGGACACAACAGGAGGUAC | 3969 |
| UACCUCCUGUUGUGUCCCU | 3970 | AGGGACACAACAGGAGGUA | 3971 |
| ACCUCCUGUUGUGUCCCUA | 3972 | UAGGGACACAACAGGAGGU | 3973 |

TABLE 4-continued

| Sense Sequence | SEQ ID NO: | Antisense Sequence | SEQ ID NO: |
|---|---|---|---|
| CCUCCUGUUGUGUCCCUAC | 3974 | GUAGGGACACAACAGGAGG | 3975 |
| CUCCUGUUGUGUCCCUACU | 3976 | AGUAGGGACACAACAGGAG | 3977 |
| UUGUGUCCCUACUGCCCGA | 3978 | UCGGGCAGUAGGGACACAA | 3979 |
| UGUGUCCCUACUGCCCGAA | 3980 | UUCGGGCAGUAGGGACACA | 3981 |
| GUGUCCCUACUGCCCGAAG | 3982 | CUUCGGGCAGUAGGGACAC | 3983 |
| UGUCCCUACUGCCCGAAGG | 3984 | CCUUCGGGCAGUAGGGACA | 3985 |
| UCUCUCCUCUACCUGGA | 3986 | UCCAGGUAGAGGAGAGAGA | 3987 |
| UCUCCUCUACCUGGAUCAU | 3988 | AUGAUCCAGGUAGAGGAGA | 3989 |
| CUCCUCUACCUGGAUCAUA | 3990 | UAUGAUCCAGGUAGAGGAG | 3991 |
| UCCUCUACCUGGAUCAUAA | 3992 | UUAUGAUCCAGGUAGAGGA | 3993 |
| CCUCUACCUGGAUCAUAAU | 3994 | AUUAUGAUCCAGGUAGAGG | 3995 |
| CUCUACCUGGAUCAUAAUG | 3996 | CAUUAUGAUCCAGGUAGAG | 3997 |
| UCUACCUGGAUCAUAAUGG | 3998 | CCAUUAUGAUCCAGGUAGA | 3999 |
| CUACCUGGAUCAUAAUGGC | 4000 | GCCAUUAUGAUCCAGGUAG | 4001 |
| UACCUGGAUCAUAAUGGCA | 4002 | UGCCAUUAUGAUCCAGGUA | 4003 |
| ACCUGGAUCAUAAUGGCAA | 4004 | UUGCCAUUAUGAUCCAGGU | 4005 |
| CCUGGAUCAUAAUGGCAAU | 4006 | AUUGCCAUUAUGAUCCAGG | 4007 |
| CUGGAUCAUAAUGGCAAUG | 4008 | CAUUGCCAUUAUGAUCCAG | 4009 |
| UGGAUCAUAAUGGCAAUGU | 4010 | ACAUUGCCAUUAUGAUCCA | 4011 |
| GGAUCAUAAUGGCAAUGUG | 4012 | CACAUUGCCAUUAUGAUCC | 4013 |
| GAUCAUAAUGGCAAUGUGG | 4014 | CCACAUUGCCAUUAUGAUC | 4015 |
| AUAAUGGCAAUGUGGUCAA | 4016 | UUGACCACAUUGCCAUUAU | 4017 |
| UAAUGGCAAUGUGGUCAAG | 4018 | CUUGACCACAUUGCCAUUA | 4019 |
| AAUGGCAAUGUGGUCAAGA | 4020 | UCUUGACCACAUUGCCAUU | 4021 |
| AAUGUGGUCAAGACGGAUG | 4022 | CAUCCGUCUUGACCACAUU | 4023 |
| AUGUGGUCAAGACGGAUGU | 4024 | ACAUCCGUCUUGACCACAU | 4025 |
| UGUGGUCAAGACGGAUGUG | 4026 | CACAUCCGUCUUGACCACA | 4027 |
| GUGGUCAAGACGGAUGUGC | 4028 | GCACAUCCGUCUUGACCAC | 4029 |
| UGGUCAAGACGGAUGUGCC | 4030 | GGCACAUCCGUCUUGACCA | 4031 |
| GGUCAAGACGGAUGUGCCA | 4032 | UGGCACAUCCGUCUUGACC | 4033 |
| GUCAAGACGGAUGUGCCAG | 4034 | CUGGCACAUCCGUCUUGAC | 4035 |
| UCAAGACGGAUGUGCCAGA | 4036 | UCUGGCACAUCCGUCUUGA | 4037 |
| CAAGACGGAUGUGCCAGAU | 4038 | AUCUGGCACAUCCGUCUUG | 4039 |
| AAGACGGAUGUGCCAGAUA | 4040 | UAUCUGGCACAUCCGUCUU | 4041 |
| AGACGGAUGUGCCAGAUAU | 4042 | AUAUCUGGCACAUCCGUCU | 4043 |
| GACGGAUGUGCCAGAUAUG | 4044 | CAUAUCUGGCACAUCCGUC | 4045 |
| ACGGAUGUGCCAGAUAUGG | 4046 | CCAUAUCUGGCACAUCCGU | 4047 |
| CGGAUGUGCCAGAUAUGGU | 4048 | ACCAUAUCUGGCACAUCCG | 4049 |
| GGAUGUGCCAGAUAUGGUG | 4050 | CACCAUAUCUGGCACAUCC | 4051 |
| GAUGUGCCAGAUAUGGUGG | 4052 | CCACCAUAUCUGGCACAUC | 4053 |
| GCCAGAUAUGGUGGUGGAG | 4054 | CUCCACCACCAUAUCUGGC | 4055 |
| CCAGAUAUGGUGGUGGAGG | 4056 | CCUCCACCACCAUAUCUGG | 4057 |
| CAGAUAUGGUGGUGGAGGC | 4058 | GCCUCCACCACCAUAUCUG | 4059 |
| AGAUAUGGUGGUGGAGGCC | 4060 | GGCCUCCACCACCAUAUCU | 4061 |
| GAUAUGGUGGUGGAGGCCU | 4062 | AGGCCUCCACCACCAUAUC | 4063 |
| AUAUGGUGGUGGAGGCCUG | 4064 | CAGGCCUCCACCACCAUAU | 4065 |
| CCUGUGGCUGCAGCUAGCA | 4066 | UGCUAGCUGCAGCCACAGG | 4067 |
| UGUGGCUGCAGCUAGCAAG | 4068 | CUUGCUAGCUGCAGCCACA | 4069 |
| GUGGCUGCAGCUAGCAAGA | 4070 | UCUUGCUAGCUGCAGCCAC | 4071 |
| UGGCUGCAGCUAGCAAGAG | 4072 | CUCUUGCUAGCUGCAGCCA | 4073 |
| GGCUGCAGCUAGCAAGAGG | 4074 | CCUCUUGCUAGCUGCAGCC | 4075 |
| CUGCAGCUAGCAAGAGGAC | 4076 | GUCCUCUUGCUAGCUGCAG | 4077 |
| CAGCUAGCAAGAGGACCUG | 4078 | CAGGUCCUCUUGCUAGCUG | 4079 |
| GCUAGCAAGAGGACCUGGG | 4080 | CCCAGGUCCUCUUGCUAGC | 4081 |
| AGACCAAGAUGAAGUUUCC | 4082 | GGAAACUUCAUCUUGGUCU | 4083 |
| UGAAGUUUCCCAGGCACAG | 4084 | CUGUGCCUGGGAAACUUCA | 4085 |
| GAAGUUUCCCAGGCACAGG | 4086 | CCUGUGCCUGGGAAACUUC | 4087 |
| UCCCAGGCACAGGGCAUCU | 4088 | AGAUGCCCGUGCCUGGGA | 4089 |
| GGCAUCUGUGACUGGAGGC | 4090 | GCCUCCAGUCACAGAUGCC | 4091 |
| GCAUCUGUGACUGGAGGCA | 4092 | UGCCUCCAGUCACAGAUGC | 4093 |
| CAACCACCUGGCAAUAUGA | 4094 | UCAUAUUGCCAGGUGGUUG | 4095 |
| AACCACCUGGCAAUAUGAC | 4096 | GUCAUAUUGCCAGGUGGUU | 4097 |
| ACCACCUGGCAAUAUGACU | 4098 | AGUCAUAUUGCCAGGUGGU | 4099 |
| CCACCUGGCAAUAUGACUC | 4100 | GAGUCAUAUUGCCAGGUGG | 4101 |
| CACCUGGCAAUAUGACUCA | 4102 | UGAGUCAUAUUGCCAGGUG | 4103 |
| ACCUGGCAAUAUGACUCAC | 4104 | GUGAGUCAUAUUGCCAGGU | 4105 |
| CCUGGCAAUAUGACUCACU | 4106 | AGUGAGUCAUAUUGCCAGG | 4107 |
| CUGGCAAUAUGACUCACUU | 4108 | AAGUGAGUCAUAUUGCCAG | 4109 |
| UGGCAAUAUGACUCACUUG | 4110 | CAAGUGAGUCAUAUUGCCA | 4111 |
| AAUAUGACUCACUUGACCC | 4112 | GGGUCAAGUGAGUCAUAUU | 4113 |
| CCCUAUGGGACCCAAAUGG | 4114 | CCAUUUGGGUCCCAUAGGG | 4115 |
| CCUAUGGGACCCAAAUGGG | 4116 | CCCAUUUGGGUCCCAUAGG | 4117 |
| CUAUGGGACCCAAAUGGGC | 4118 | GCCCAUUUGGGUCCCAUAG | 4119 |
| UAUGGGACCCAAAUGGGCA | 4120 | UGCCCAUUUGGGUCCCAUA | 4121 |
| AUGGGACCCAAAUGGGCAC | 4122 | GUGCCCAUUUGGGUCCCAU | 4123 |
| CCCAAAUGGGCACUUUCUU | 4124 | AAGAAAGUGCCCAUUUGGG | 4125 |

TABLE 4-continued

| Sense Sequence | SEQ ID NO: | Antisense Sequence | SEQ ID NO: |
|---|---|---|---|
| CCAAAUGGGCACUUUCUUG | 4126 | CAAGAAAGUGCCCAUUUGG | 4127 |
| CAAAUGGGCACUUUCUUGU | 4128 | ACAAGAAAGUGCCCAUUUG | 4129 |
| AAAUGGGCACUUUCUUGUC | 4130 | GACAAGAAAGUGCCCAUUU | 4131 |
| AAUGGGCACUUUCUUGUCU | 4132 | AGACAAGAAAGUGCCCAUU | 4133 |
| UGGGCACUUUCUUGUCUGA | 4134 | UCAGACAAGAAAGUGCCCA | 4135 |
| GGGCACUUUCUUGUCUGAG | 4136 | CUCAGACAAGAAAGUGCCC | 4137 |
| UGGCUUAUUCCAGGUUGGC | 4138 | GCCAACCUGGAAUAAGCCA | 4139 |
| GGCUUAUUCCAGGUUGGCU | 4140 | AGCCAACCUGGAAUAAGCC | 4141 |
| GCUUAUUCCAGGUUGGCUG | 4142 | CAGCCAACCUGGAAUAAGC | 4143 |
| CUUAUUCCAGGUUGGCUGA | 4144 | UCAGCCAACCUGGAAUAAG | 4145 |
| UUCCAGGUUGGCUGAUGUG | 4146 | CACAUCAGCCAACCUGGAA | 4147 |
| UCCAGGUUGGCUGAUGUGU | 4148 | ACACAUCAGCCAACCUGGA | 4149 |
| CCAGGUUGGCUGAUGUGUU | 4150 | AACACAUCAGCCAACCUGG | 4151 |
| CAGGUUGGCUGAUGUGUUG | 4152 | CAACACAUCAGCCAACCUG | 4153 |
| AGGUUGGCUGAUGUGUUGG | 4154 | CCAACACAUCAGCCAACCU | 4155 |
| GGUUGGCUGAUGUGUUGGG | 4156 | CCCAACACAUCAGCCAACC | 4157 |
| AGAUGGGUAAAGCGUUUCU | 4158 | AGAAACGCUUUACCCAUCU | 4159 |
| GAUGGGUAAAGCGUUUCUU | 4160 | AAGAAACGCUUUACCCAUC | 4161 |
| AUGGGUAAAGCGUUUCUUC | 4162 | GAAGAAACGCUUUACCCAU | 4163 |
| UGGGUAAAGCGUUUCUUCU | 4164 | AGAAGAAACGCUUUACCCA | 4165 |
| GGGUAAAGCGUUUCUUCUA | 4166 | UAGAAGAAACGCUUUACCC | 4167 |
| GGUAAAGCGUUUCUUCUAA | 4168 | UUAGAAGAAACGCUUUACC | 4169 |
| GUAAAGCGUUUCUUCUAAA | 4170 | UUUAGAAGAAACGCUUUAC | 4171 |
| UAAAGCGUUUCUUCUAAAG | 4172 | CUUUAGAAGAAACGCUUUA | 4173 |
| AAAGCGUUUCUUCUAAAGG | 4174 | CCUUUAGAAGAAACGCUUU | 4175 |
| AAGCGUUUCUUCUAAAGGG | 4176 | CCCUUUAGAAGAAACGCUU | 4177 |
| AAAGCAUGAUUCCUGCCC | 4178 | GGGCAGGAAAUCAUGCUUU | 4179 |
| AAGCAUGAUUUCCUGCCCU | 4180 | AGGGCAGGAAAUCAUGCUU | 4181 |
| AGCAUGAUUUCCUGCCCUA | 4182 | UAGGGCAGGAAAUCAUGCU | 4183 |
| GCAUGAUUUCCUGCCCUAA | 4184 | UUAGGGCAGGAAAUCAUGC | 4185 |
| CAUGAUUUCCUGCCCUAAG | 4186 | CUUAGGGCAGGAAAUCAUG | 4187 |
| AUGAUUUCCUGCCCUAAGU | 4188 | ACUUAGGGCAGGAAAUCAU | 4189 |
| UGAUUUCCUGCCCUAAGUC | 4190 | GACUUAGGGCAGGAAAUCA | 4191 |
| GAUUUCCUGCCCUAAGUCC | 4192 | GGACUUAGGGCAGGAAAUC | 4193 |
| AUUUCCUGCCCUAAGUCCU | 4194 | AGGACUUAGGGCAGGAAAU | 4195 |
| UUUCCUGCCCUAAGUCCUG | 4196 | CAGGACUUAGGGCAGGAAA | 4197 |
| UUCCUGCCCUAAGUCCUGU | 4198 | ACAGGACUUAGGGCAGGAA | 4199 |
| UCCUGCCCUAAGUCCUGUG | 4200 | CACAGGACUUAGGGCAGGA | 4201 |
| AGAAGAUGUCAGGGACUAG | 4202 | CUAGUCCCUGACAUCUUCU | 4203 |
| GAAGAUGUCAGGGACUAGG | 4204 | CCUAGUCCCUGACAUCUUC | 4205 |
| AAGAUGUCAGGGACUAGGG | 4206 | CCCUAGUCCCUGACAUCUU | 4207 |
| AGAUGUCAGGGACUAGGGA | 4208 | UCCCUAGUCCCUGACAUCU | 4209 |
| GUCAGGGACUAGGGAGGGA | 4210 | UCCCUCCCUAGUCCCUGAC | 4211 |
| UACUUAGCCUCUCCCAAGA | 4212 | UCUUGGGAGAGGCUAAGUA | 4213 |
| AGGAGGAAGCAGAUAGAUG | 4214 | CAUCUAUCUGCUUCCUCCU | 4215 |
| GGAGGAAGCAGAUAGAUGG | 4216 | CCAUCUAUCUGCUUCCUCC | 4217 |
| GAGGAAGCAGAUAGAUGGU | 4218 | ACCAUCUAUCUGCUUCCUC | 4219 |
| AGGAAGCAGAUAGAUGGUC | 4220 | GACCAUCUAUCUGCUUCCU | 4221 |
| GGAAGCAGAUAGAUGGUCC | 4222 | GGACCAUCUAUCUGCUUCC | 4223 |
| GAAGCAGAUAGAUGGUCCA | 4224 | UGGACCAUCUAUCUGCUUC | 4225 |
| UAGAUGGUCCAGCAGGCUU | 4226 | AAGCCUGCUGGACCAUCUA | 4227 |
| AGAUGGUCCAGCAGGCUUG | 4228 | CAAGCCUGCUGGACCAUCU | 4229 |
| GAUGGUCCAGCAGGCUUGA | 4230 | UCAAGCCUGCUGGACCAUC | 4231 |
| AUGGUCCAGCAGGCUUGAA | 4232 | UUCAAGCCUGCUGGACCAU | 4233 |
| UGGUCCAGCAGGCUUGAAG | 4234 | CUUCAAGCCUGCUGGACCA | 4235 |
| GGUCCAGCAGGCUUGAAGC | 4236 | GCUUCAAGCCUGCUGGACC | 4237 |
| GUCCAGCAGGCUUGAAGCA | 4238 | UGCUUCAAGCCUGCUGGAC | 4239 |
| UCCAGCAGGCUUGAAGCAG | 4240 | CUGCUUCAAGCCUGCUGGA | 4241 |
| CCCAGGGUAAGGGCUGUUG | 4242 | CAACAGCCCUUACCCUGGG | 4243 |
| GGGUAAGGGCUGUUGAGGU | 4244 | ACCUCAACAGCCCUUACCC | 4245 |
| GGUAAGGGCUGUUGAGGUA | 4246 | UACCUCAACAGCCCUUACC | 4247 |
| GUAAGGGCUGUUGAGGUAC | 4248 | GUACCUCAACAGCCCUUAC | 4249 |
| UAAGGGCUGUUGAGGUACC | 4250 | GGUACCUCAACAGCCCUUA | 4251 |
| AAGGGCUGUUGAGGUACCU | 4252 | AGGUACCUCAACAGCCCUU | 4253 |
| AGGGCUGUUGAGGUACCUU | 4254 | AAGGUACCUCAACAGCCCU | 4255 |
| GGGCUGUUGAGGUACCUUA | 4256 | UAAGGUACCUCAACAGCCC | 4257 |
| GGCUGUUGAGGUACCUUAA | 4258 | UUAAGGUACCUCAACAGCC | 4259 |
| GCUGUUGAGGUACCUUAAG | 4260 | CUUAAGGUACCUCAACAGC | 4261 |
| CUGUUGAGGUACCUUAAGG | 4262 | CCUUAAGGUACCUCAACAG | 4263 |
| UGUUGAGGUACCUUAAGGG | 4264 | CCCUUAAGGUACCUCAACA | 4265 |
| UAAGGGAAGGUCAAGAGGG | 4266 | CCCUCUUGACCUUCCCUUA | 4267 |
| AAGGGAAGGUCAAGAGGGA | 4268 | UCCCUCUUGACCUUCCCUU | 4269 |
| CGCUGAGGGAGGAUGCUUA | 4270 | UAAGCAUCCUCCCUCAGCG | 4271 |
| UGAGGGAGGAUGCUUAGGG | 4272 | CCCUAAGCAUCCUCCCUCA | 4273 |
| GGCACUAAGCCUAAGAAGU | 4274 | ACUUCUUAGGCUUAGUGCC | 4275 |
| GCACUAAGCCUAAGAAGUU | 4276 | AACUUCUUAGGCUUAGUGC | 4277 |

TABLE 4-continued

| Sense Sequence | SEQ ID NO: | Antisense Sequence | SEQ ID NO: |
|---|---|---|---|
| CACUAAGCCUAAGAAGUUC | 4278 | GAACUUCUUAGGCUUAGUG | 4279 |
| ACUAAGCCUAAGAAGUUCC | 4280 | GGAACUUCUUAGGCUUAGU | 4281 |
| AGAUCGAGUCUCGCUCUGU | 4282 | ACAGAGCGAGACUCGAUCU | 4283 |
| GAUCGAGUCUCGCUCUGUC | 4284 | GACAGAGCGAGACUCGAUC | 4285 |
| AUCGAGUCUCGCUCUGUCA | 4286 | UGACAGAGCGAGACUCGAU | 4287 |
| AGUCUCGCUCUGUCACCAG | 4288 | CUGGUGACAGAGCGAGACU | 4289 |
| GUCUCGCUCUGUCACCAGG | 4290 | CCUGGUGACAGAGCGAGAC | 4291 |
| UCUCGCUCUGUCACCAGGC | 4292 | GCCUGGUGACAGAGCGAGA | 4293 |
| CUCGCUCUGUCACCAGGCU | 4294 | AGCCUGGUGACAGAGCGAG | 4295 |
| GUCACCAGGCUGGAGUGCA | 4296 | UGCACUCCAGCCUGGUGAC | 4297 |
| GGCUCACUGCAACCUCCGU | 4298 | ACGGAGGUUGCAGUGAGCC | 4299 |
| GCUCACUGCAACCUCCGUC | 4300 | GACGGAGGUUGCAGUGAGC | 4301 |
| UCCGUCUCCUGGGUUCAAG | 4302 | CUUGAACCCAGGAGACGGA | 4303 |
| CCGUCUCCUGGGUUCAAGU | 4304 | ACUUGAACCCAGGAGACGG | 4305 |
| CGUCUCCUGGGUUCAAGUG | 4306 | CACUUGAACCCAGGAGACG | 4307 |
| GUCUCCUGGGUUCAAGUGA | 4308 | UCACUUGAACCCAGGAGAC | 4309 |
| UGGGUUCAAGUGAUUCUUC | 4310 | GAAGAAUCACUUGAACCCA | 4311 |
| GGGUUCAAGUGAUUCUUCU | 4312 | AGAAGAAUCACUUGAACCC | 4313 |
| GGUUCAAGUGAUUCUUCUG | 4314 | CAGAAGAAUCACUUGAACC | 4315 |
| GUUCAAGUGAUUCUUCUGC | 4316 | GCAGAAGAAUCACUUGAAC | 4317 |
| UUCAAGUGAUUCUUCUGCC | 4318 | GGCAGAAGAAUCACUUGAA | 4319 |
| UCAAGUGAUUCUUCUGCCU | 4320 | AGGCAGAAGAAUCACUUGA | 4321 |
| CGAGCAGCUGGGAUUACAG | 4322 | CUGUAAUCCCAGCUGCUCG | 4323 |
| CAGCUGGGAUUACAGGCGC | 4324 | GCGCCUGUAAUCCCAGCUG | 4325 |
| ACAUGUUGGCCAGGAUGGU | 4326 | ACCAUCCUGGCCAACAUGU | 4327 |
| CAUGUUGGCCAGGAUGGUC | 4328 | GACCAUCCUGGCCAACAUG | 4329 |
| AUGUUGGCCAGGAUGGUCU | 4330 | AGACCAUCCUGGCCAACAU | 4331 |
| UGUUGGCCAGGAUGGUCUC | 4332 | GAGACCAUCCUGGCCAACA | 4333 |
| GUUGGCCAGGAUGGUCUCA | 4334 | UGAGACCAUCCUGGCCAAC | 4335 |
| UUGGCCAGGAUGGUCUCAA | 4336 | UUGAGACCAUCCUGGCCAA | 4337 |
| UGGCCAGGAUGGUCUCAAU | 4338 | AUUGAGACCAUCCUGGCCA | 4339 |
| GGCCAGGAUGGUCUCAAUC | 4340 | GAUUGAGACCAUCCUGGCC | 4341 |
| GCCAGGAUGGUCUCAAUCU | 4342 | AGAUUGAGACCAUCCUGGC | 4343 |
| CCAGGAUGGUCUCAAUCUC | 4344 | GAGAUUGAGACCAUCCUGG | 4345 |
| CAGGAUGGUCUCAAUCUCU | 4346 | AGAGAUUGAGACCAUCCUG | 4347 |
| AGGAUGGUCUCAAUCUCUU | 4348 | AAGAGAUUGAGACCAUCCU | 4349 |
| AUUAUAGGCGUGAGCCACC | 4350 | GGUGGCUCACGCCUAUAAU | 4351 |
| UUAUAGGCGUGAGCCACCG | 4352 | CGGUGGCUCACGCCUAUAA | 4353 |
| UAUAGGCGUGAGCCACCGC | 4354 | GCGGUGGCUCACGCCUAUA | 4355 |
| GCGCCUGGCUUAUACUUUC | 4356 | GAAAGUAUAAGCCAGGCGC | 4357 |
| CGCCUGGCUUAUACUUUCU | 4358 | AGAAAGUAUAAGCCAGGCG | 4359 |
| CCUGGCUUAUACUUUCUUA | 4360 | UAAGAAAGUAUAAGCCAGG | 4361 |
| CUGGCUUAUACUUUCUUAA | 4362 | UUAAGAAAGUAUAAGCCAG | 4363 |
| CAAAUGUGAGUCAUAAAGA | 4364 | UCUUUAUGACUCACAUUUG | 4365 |
| AAUGUGAGUCAUAAAGAAG | 4366 | CUUCUUUAUGACUCACAUU | 4367 |
| UGAGUCAUAAAGAAGGGUU | 4368 | AACCCUUCUUUAUGACUCA | 4369 |
| AGUCAUAAAGAAGGGUUAG | 4370 | CUAACCCUUCUUUAUGACU | 4371 |
| GUCAUAAAGAAGGGUUAGG | 4372 | CCUAACCCUUCUUUAUGAC | 4373 |
| UCAUAAAGAAGGGUUAGGG | 4374 | CCCUAACCCUUCUUUAUGA | 4375 |
| CAUAAAGAAGGGUUAGGGU | 4376 | ACCCUAACCCUUCUUUAUG | 4377 |
| AAGAAGGGUUAGGGUGAUG | 4378 | CAUCACCCUAACCCUUCUU | 4379 |
| AGAAGGGUUAGGGUGAUGG | 4380 | CCAUCACCCUAACCCUUCU | 4381 |
| GAAGGGUUAGGGUGAUGGU | 4382 | ACCAUCACCCUAACCCUUC | 4383 |
| AAGGGUUAGGGUGAUGGUC | 4384 | GACCAUCACCCUAACCCUU | 4385 |
| AGGGUUAGGGUGAUGGUCC | 4386 | GGACCAUCACCCUAACCCU | 4387 |
| GGGUUAGGGUGAUGGUCCA | 4388 | UGGACCAUCACCCUAACCC | 4389 |
| GGGUGAUGGUCCAGAGCAA | 4390 | UUGCUCUGGACCAUCACCC | 4391 |
| GGUGAUGGUCCAGAGCAAC | 4392 | GUUGCUCUGGACCAUCACC | 4393 |
| ACAGUUCUUCAAGUGUACU | 4394 | AGUACACUUGAAGAACUGU | 4395 |
| CAGUUCUUCAAGUGUACUC | 4396 | GAGUACACUUGAAGAACUG | 4397 |
| AGUUCUUCAAGUGUACUCU | 4398 | AGAGUACACUUGAAGAACU | 4399 |
| CAAGUGUACUCUGUAGGCU | 4400 | AGCCUACAGAGUACACUUG | 4401 |
| AAGUGUACUCUGUAGGCUU | 4402 | AAGCCUACAGAGUACACUU | 4403 |
| GUGUACUCUGUAGGCUUCU | 4404 | AGAAGCCUACAGAGUACAC | 4405 |
| UGUACUCUGUAGGCUUCUG | 4406 | CAGAAGCCUACAGAGUACA | 4407 |
| GUACUCUGUAGGCUUCUGG | 4408 | CCAGAAGCCUACAGAGUAC | 4409 |
| UACUCUGUAGGCUUCUGGG | 4410 | CCCAGAAGCCUACAGAGUA | 4411 |
| GUAGGCUUCUGGGAGGUCC | 4412 | GGACCUCCCAGAAGCCUAC | 4413 |
| UAGGCUUCUGGGAGGUCCC | 4414 | GGGACCUCCCAGAAGCCUA | 4415 |
| AGGCUUCUGGGAGGUCCCU | 4416 | AGGGACCUCCCAGAAGCCU | 4417 |
| GGCUUCUGGGAGGUCCCUU | 4418 | AAGGGACCUCCCAGAAGCC | 4419 |
| GCUUCUGGGAGGUCCCUUU | 4420 | AAAGGGACCUCCCAGAAGC | 4421 |
| CUUCUGGGAGGUCCCUUUU | 4422 | AAAAGGGACCUCCCAGAAG | 4423 |
| UUCUGGGAGGUCCCUUUUC | 4424 | GAAAAGGGACCUCCCAGAA | 4425 |
| UCUGGGAGGUCCCUUUUCA | 4426 | UGAAAAGGGACCUCCCAGA | 4427 |
| CAUGUUAUUGCCUUUUGA | 4428 | UCAAAAGGCAAUAACAUG | 4429 |

TABLE 4-continued

| Sense Sequence | SEQ ID NO: | Antisense Sequence | SEQ ID NO: |
|---|---|---|---|
| AUUUGCCUUUUGAAUUCUC | 4430 | GAGAAUUCAAAAGGCAAAU | 4431 |
| UUUGCCUUUUGAAUUCUCA | 4432 | UGAGAAUUCAAAAGGCAAA | 4433 |
| UUGCCUUUUGAAUUCUCAU | 4434 | AUGAGAAUUCAAAAGGCAA | 4435 |
| UGCCUUUUGAAUUCUCAUU | 4436 | AAUGAGAAUUCAAAAGGCA | 4437 |
| GCCUUUUGAAUUCUCAUUA | 4438 | UAAUGAGAAUUCAAAAGGC | 4439 |
| AUUGUAUUGUGGAGUUUUC | 4440 | GAAAACUCCACAAUACAAU | 4441 |
| UUGUAUUGUGGAGUUUUCC | 4442 | GGAAAACUCCACAAUACAA | 4443 |
| AGUUUUCCAGAGGCCGUGU | 4444 | ACACGGCCUCUGGAAAACU | 4445 |
| GUUUUCCAGAGGCCGUGUG | 4446 | CACACGGCCUCUGGAAAAC | 4447 |
| UUUUCCAGAGGCCGUGUGA | 4448 | UCACACGGCCUCUGGAAAA | 4449 |
| UUUCCAGAGGCCGUGUGAC | 4450 | GUCACACGGCCUCUGGAAA | 4451 |
| UUCCAGAGGCCGUGUGACA | 4452 | UGUCACACGGCCUCUGGAA | 4453 |
| UCCAGAGGCCGUGUGACAU | 4454 | AUGUCACACGGCCUCUGGA | 4455 |
| CCAGAGGCCGUGUGACAUG | 4456 | CAUGUCACACGGCCUCUGG | 4457 |
| CAGAGGCCGUGUGACAUGU | 4458 | ACAUGUCACACGGCCUCUG | 4459 |
| AGAGGCCGUGUGACAUGUG | 4460 | CACAUGUCACACGGCCUCU | 4461 |
| GCCGUGUGACAUGUGAUUA | 4462 | UAAUCACAUGUCACACGGC | 4463 |
| CCGUGUGACAUGUGAUUAC | 4464 | GUAAUCACAUGUCACACGG | 4465 |
| CGUGUGACAUGUGAUUACA | 4466 | UGUAAUCACAUGUCACACG | 4467 |
| GAUUACAUCAUCUUUCUGA | 4468 | UCAGAAAGAUGAUGUAAUC | 4469 |
| AUUACAUCAUCUUUCUGAC | 4470 | GUCAGAAAGAUGAUGUAAU | 4471 |
| UUACAUCAUCUUUCUGACA | 4472 | UGUCAGAAAGAUGAUGUAA | 4473 |
| UACAUCAUCUUUCUGACAU | 4474 | AUGUCAGAAAGAUGAUGUA | 4475 |
| AUCUUUCUGACAUCAUUGU | 4476 | ACAAUGAUGUCAGAAAGAU | 4477 |
| AUUGUUAAUGGAAUGUGUG | 4478 | CACACAUUCCAUUAACAAU | 4479 |
| GAAUGUGUGCUUGUAUGGU | 4480 | ACCAUACAAGCACACAUUC | 4481 |
| AAUGUGUGCUUGUAUGGUC | 4482 | GACCAUACAAGCACACAUU | 4483 |
| AUGUGUGCUUGUAUGGUCU | 4484 | AGACCAUACAAGCACACAU | 4485 |
| UGUGUGCUUGUAUGGUCUU | 4486 | AAGACCAUACAAGCACACA | 4487 |
| GUGUGCUUGUAUGGUCUUG | 4488 | CAAGACCAUACAAGCACAC | 4489 |
| UGUGCUUGUAUGGUCUUGU | 4490 | ACAAGACCAUACAAGCACA | 4491 |
| GUGCUUGUAUGGUCUUGUG | 4492 | CACAAGACCAUACAAGCAC | 4493 |
| UGCUUGUAUGGUCUUGUGU | 4494 | ACACAAGACCAUACAAGCA | 4495 |
| GCUUGUAUGGUCUUGUGUU | 4496 | AACACAAGACCAUACAAGC | 4497 |
| CUUGUAUGGUCUUGUGUUA | 4498 | UAACACAAGACCAUACAAG | 4499 |
| UAUGGUCUUGUGUUACAGU | 4500 | ACUGUAACACAAGACCAUA | 4501 |
| AUGGUCUUGUGUUACAGUC | 4502 | GACUGUAACACAAGACCAU | 4503 |
| AGUCUCGCUCUGUCGCCCA | 4504 | UGGGCGACAGAGCGAGACU | 4505 |
| CAAUCUCGGCUCACUGCAA | 4506 | UUGCAGUGAGCCGAGAUUG | 4507 |
| AAUCUCGGCUCACUGCAAC | 4508 | GUUGCAGUGAGCCGAGAUU | 4509 |
| AUCUCGGCUCACUGCAACC | 4510 | GGUUGCAGUGAGCCGAGAU | 4511 |
| UCUCGGCUCACUGCAACCU | 4512 | AGGUUGCAGUGAGCCGAGA | 4513 |
| CUCACUGCAACCUCCACCU | 4514 | AGGUGGAGGUUGCAGUGAG | 4515 |
| UCACUGCAACCUCCACCUC | 4516 | GAGGUGGAGGUUGCAGUGA | 4517 |
| CACUGCAACCUCCACCUCC | 4518 | GGAGGUGGAGGUUGCAGUG | 4519 |
| ACUGCAACCUCCACCUCCC | 4520 | GGGAGGUGGAGGUUGCAGU | 4521 |
| AGCCUCCUGAGUAGCUGGG | 4522 | CCCAGCUACUCAGGAGGCU | 4523 |
| GCCUCCUGAGUAGCUGGGA | 4524 | UCCCAGCUACUCAGGAGGC | 4525 |
| CCUCCUGAGUAGCUGGGAC | 4526 | GUCCCAGCUACUCAGGAGG | 4527 |
| CUCCUGAGUAGCUGGGACU | 4528 | AGUCCCAGCUACUCAGGAG | 4529 |
| UCCUGAGUAGCUGGGACUA | 4530 | UAGUCCCAGCUACUCAGGA | 4531 |
| UAGCUGGGACUACAGGCCU | 4532 | AGGCCUGUAGUCCCAGCUA | 4533 |
| AGCUGGGACUACAGGCCUG | 4534 | CAGGCCUGUAGUCCCAGCU | 4535 |
| GCCACCAUGCCCAGCUAUU | 4536 | AAUAGCUGGGCAUGGUGGC | 4537 |
| CCACCAUGCCCAGCUAUUU | 4538 | AAAUAGCUGGGCAUGGUGG | 4539 |
| CACCAUGCCCAGCUAUUUU | 4540 | AAAAUAGCUGGGCAUGGUG | 4541 |
| GGGUUUCACCAUGUUGGCC | 4542 | GGCCAACAUGGUGAAACCC | 4543 |
| GGUUUCACCAUGUUGGCCA | 4544 | UGGCCAACAUGGUGAAACC | 4545 |
| GUUUCACCAUGUUGGCCAG | 4546 | CUGGCCAACAUGGUGAAAC | 4547 |
| CACCAUGUUGGCCAGGCUG | 4548 | CAGCCUGGCCAACAUGGUG | 4549 |
| ACCAUGUUGGCCAGGCUGG | 4550 | CCAGCCUGGCCAACAUGGU | 4551 |
| CCAUGUUGGCCAGGCUGGU | 4552 | ACCAGCCUGGCCAACAUGG | 4553 |
| CAUGUUGGCCAGGCUGGUC | 4554 | GACCAGCCUGGCCAACAUG | 4555 |
| AUGUUGGCCAGGCUGGUCU | 4556 | AGACCAGCCUGGCCAACAU | 4557 |
| UGUUGGCCAGGCUGGUCUC | 4558 | GAGACCAGCCUGGCCAACA | 4559 |
| CUUGAGGUGAUCCGCCUGC | 4560 | GCAGGCGGAUCACCUCAAG | 4561 |
| UUGAGGUGAUCCGCCUGCC | 4562 | GGCAGGCGGAUCACCUCAA | 4563 |
| UGAGGUGAUCCGCCUGCCU | 4564 | AGGCAGGCGGAUCACCUCA | 4565 |
| CCAAAGUGCUGGGAUUACA | 4566 | UGUAAUCCCAGCACUUUGG | 4567 |
| CAAAGUGCUGGGAUUACAG | 4568 | CUGUAAUCCCAGCACUUUG | 4569 |
| GUGCUGGGAUUACAGGUCU | 4570 | AGACCUGUAAUCCCAGCAC | 4571 |
| UGCUGGGAUUACAGGUCUG | 4572 | CAGACCUGUAAUCCCAGCA | 4573 |
| GCUGGGAUUACAGGUCUGA | 4574 | UCAGACCUGUAAUCCCAGC | 4575 |
| CUGGGAUUACAGGUCUGAG | 4576 | CUCAGACCUGUAAUCCCAG | 4577 |
| GGCUGAGCCACUGUGCCU | 4578 | AGGCACAGUGGCUCAGCC | 4579 |
| GUCUGAGCCACUGUGCCUA | 4580 | UAGGCACAGUGGCUCAGAC | 4581 |

TABLE 4-continued

| Sense Sequence | SEQ ID NO: | Antisense Sequence | SEQ ID NO: |
|---|---|---|---|
| UCUGAGCCACUGUGCCUAA | 4582 | UUAGGCACAGUGGCUCAGA | 4583 |
| CUGAGCCACUGUGCCUAAC | 4584 | GUUAGGCACAGUGGCUCAG | 4585 |
| UGAGCCACUGUGCCUAACC | 4586 | GGUUAGGCACAGUGGCUCA | 4587 |
| CACUGUGCCUAACCUAAUG | 4588 | CAUUAGGUUAGGCACAGUG | 4589 |
| ACUGUGCCUAACCUAAUGA | 4590 | UCAUUAGGUUAGGCACAGU | 4591 |
| CUGUGCCUAACCUAAUGAC | 4592 | GUCAUUAGGUUAGGCACAG | 4593 |
| UGUGCCUAACCUAAUGACU | 4594 | AGUCAUUAGGUUAGGCACA | 4595 |
| GUGCCUAACCUAAUGACUU | 4596 | AAGUCAUUAGGUUAGGCAC | 4597 |
| UGCCUAACCUAAUGACUUU | 4598 | AAAGUCAUUAGGUUAGGCA | 4599 |
| GCCUAACCUAAUGACUUUU | 4600 | AAAAGUCAUUAGGUUAGGC | 4601 |
| CCUAACCUAAUGACUUUUA | 4602 | UAAAAGUCAUUAGGUUAGG | 4603 |
| ACCUAAUGACUUUUAAGAG | 4604 | CUCUUAAAAGUCAUUAGGU | 4605 |
| CUUUUAAGAGUAUAGAGGA | 4606 | UCCUCUAUACUCUUAAAAG | 4607 |
| GACUCACUGGUCUAUAGAA | 4608 | UUCUAUAGACCAGUGAGUC | 4609 |
| AAAGUAAGGUGUUCUAAGA | 4610 | UCUUAGAACACCUUACUUU | 4611 |
| GAGCUCUUCUUGCUGGGCA | 4612 | UGCCCAGCAAGAAGAGCUC | 4613 |
| AGCUCUUCUUGCUGGGCAC | 4614 | GUGCCCAGCAAGAAGAGCU | 4615 |
| GCUCUUCUUGCUGGGCACC | 4616 | GGUGCCCAGCAAGAAGAGC | 4617 |
| CUCUUCUUGCUGGGCACCG | 4618 | CGGUGCCCAGCAAGAAGAG | 4619 |
| UCUUCUUGCUGGGCACCGG | 4620 | CCGGUGCCCAGCAAGAAGA | 4621 |
| CUUCUUGCUGGGCACCGGU | 4622 | ACCGGUGCCCAGCAAGAAG | 4623 |
| UUCUUGCUGGGCACCGGUG | 4624 | CACCGGUGCCCAGCAAGAA | 4625 |
| CCCAGGAGUUCGAGGCUAU | 4626 | AUAGCCUCGAACUCCUGGG | 4627 |
| CCAGGAGUUCGAGGCUAUG | 4628 | CAUAGCCUCGAACUCCUGG | 4629 |
| AGUUCGAGGCUAUGAUCAC | 4630 | GUGAUCAUAGCCUCGAACU | 4631 |
| GUUCGAGGCUAUGAUCACA | 4632 | UGUGAUCAUAGCCUCGAAC | 4633 |
| UUCGAGGCUAUGAUCACAC | 4634 | GUGUGAUCAUAGCCUCGAA | 4635 |
| UCGAGGCUAUGAUCACACU | 4636 | AGUGUGAUCAUAGCCUCGA | 4637 |
| CGAGGCUAUGAUCACACUU | 4638 | AAGUGUGAUCAUAGCCUCG | 4639 |
| GAGGCUAUGAUCACACUUG | 4640 | CAAGUGUGAUCAUAGCCUC | 4641 |
| UGCACUCCAGCCUGGGCAA | 4642 | UUGCCCAGGCUGGAGUGCA | 4643 |
| GCACUCCAGCCUGGGCAAA | 4644 | UUUGCCCAGGCUGGAGUGC | 4645 |
| CACUCCAGCCUGGGCAAAU | 4646 | AUUUGCCCAGGCUGGAGUG | 4647 |
| ACUCCAGCCUGGGCAAAUA | 4648 | UAUUUGCCCAGGCUGGAGU | 4649 |
| UACAUAAUAGCUCCUCUG | 4650 | CAGAGGAGCUAUUUAUGUA | 4651 |
| ACAUAAUAGCUCCUCUGG | 4652 | CCAGAGGAGCUAUUUAUGU | 4653 |
| CAUAAUAGCUCCUCUGGA | 4654 | UCCAGAGGAGCUAUUUAUG | 4655 |
| AUAAAUAGCUCCUCUGGAA | 4656 | UUCCAGAGGAGCUAUUUAU | 4657 |
| AAAUAGCUCCUCUGGAAGA | 4658 | UCUUCCAGAGGAGCUAUUU | 4659 |
| AGGCUGGGACAGGAGCAUG | 4660 | CAUGCUCCUGUCCCAGCCU | 4661 |
| GGCUGGGACAGGAGCAUGU | 4662 | ACAUGCUCCUGUCCCAGCC | 4663 |
| GCUGGGACAGGAGCAUGUG | 4664 | CACAUGCUCCUGUCCCAGC | 4665 |
| UGGGACAGGAGCAUGUGUG | 4666 | CACACAUGCUCCUGUCCCA | 4667 |
| GGGACAGGAGCAUGUGUGG | 4668 | CCACACAUGCUCCUGUCCC | 4669 |
| GGACAGGAGCAUGUGUGGG | 4670 | CCCACACAUGCUCCUGUCC | 4671 |
| UUUUCAGUGCCCAUUAGUC | 4672 | GACUAAUGGGCACUGAAAA | 4673 |
| UUUCAGUGCCCAUUAGUCU | 4674 | AGACUAAUGGGCACUGAAA | 4675 |
| UUCAGUGCCCAUUAGUCUG | 4676 | CAGACUAAUGGGCACUGAA | 4677 |
| CAGUGCCCAUUAGUCUGGU | 4678 | ACCAGACUAAUGGGCACUG | 4679 |
| AGUGCCCAUUAGUCUGGUC | 4680 | GACCAGACUAAUGGGCACU | 4681 |
| GUGCCCAUUAGUCUGGUCU | 4682 | AGACCAGACUAAUGGGCAC | 4683 |
| UGCCCAUUAGUCUGGUCUG | 4684 | CAGACCAGACUAAUGGGCA | 4685 |
| GCCCAUUAGUCUGGUCUGA | 4686 | UCAGACCAGACUAAUGGGC | 4687 |
| GUCUGGUCUGACUGAGCUG | 4688 | CAGCUCAGUCAGACCAGAC | 4689 |
| UCUGGUCUGACUGAGCUGG | 4690 | CCAGCUCAGUCAGACCAGA | 4691 |
| CUGGUCUGACUGAGCUGGG | 4692 | CCCAGCUCAGUCAGACCAG | 4693 |
| UGGUCUGACUGAGCUGGGU | 4694 | ACCCAGCUCAGUCAGACCA | 4695 |
| GGUCUGACUGAGCUGGGUC | 4696 | GACCCAGCUCAGUCAGACC | 4697 |
| GUCUGACUGAGCUGGGUCU | 4698 | AGACCCAGCUCAGUCAGAC | 4699 |
| UCUGACUGAGCUGGGUCUC | 4700 | GAGACCCAGCUCAGUCAGA | 4701 |
| CUGACUGAGCUGGGUCUCU | 4702 | AGAGACCCAGCUCAGUCAG | 4703 |
| UGACUGAGCUGGGUCUCUG | 4704 | CAGAGACCCAGCUCAGUCA | 4705 |
| GACUGAGCUGGGUCUCUGA | 4706 | UCAGAGACCCAGCUCAGUC | 4707 |
| ACUGAGCUGGGUCUCUGAC | 4708 | GUCAGAGACCCAGCUCAGU | 4709 |
| GGGAUAACUAGCCUGGGUC | 4710 | GACCCAGGCUAGUUAUCCC | 4711 |
| GGAUAACUAGCCUGGGUCA | 4712 | UGACCCAGGCUAGUUAUCC | 4713 |
| GAUAACUAGCCUGGGUCAA | 4714 | UUGACCCAGGCUAGUUAUC | 4715 |
| AUAACUAGCCUGGGUCAAA | 4716 | UUUGACCCAGGCUAGUUAU | 4717 |
| UAACUAGCCUGGGUCAAAG | 4718 | CUUUGACCCAGGCUAGUUA | 4719 |
| AACUAGCCUGGGUCAAAGU | 4720 | ACUUUGACCCAGGCUAGUU | 4721 |
| ACUAGCCUGGGUCAAAGUC | 4722 | GACUUUGACCCAGGCUAGU | 4723 |
| CUAGCCUGGGUCAAAGUCC | 4724 | GGACUUUGACCCAGGCUAG | 4725 |
| UAGCCUGGGUCAAAGUCCC | 4726 | GGGACUUUGACCCAGGCUA | 4727 |
| GGUCAAAGUCCCAGAUCUC | 4728 | GAGAUCUGGGACUUUGACC | 4729 |
| GUCAAAGUCCCAGAUCUCC | 4730 | GGAGAUCUGGGACUUUGAC | 4731 |
| UCAAAGUCCCAGAUCUCCC | 4732 | GGGAGAUCUGGGACUUUGA | 4733 |

TABLE 4-continued

| Sense Sequence | SEQ ID NO: | Antisense Sequence | SEQ ID NO: |
|---|---|---|---|
| CCUACCUUCACCUUUUCUU | 4734 | AAGAAAAGGUGAAGGUAGG | 4735 |
| CCUUCACCUUUUCUUUUCC | 4736 | GGAAAAGAAAAGGUGAAGG | 4737 |
| AACCCACUGACCUUCCACA | 4738 | UGUGGAAGGUCAGUGGGUU | 4739 |
| ACCCACUGACCUUCCACAC | 4740 | GUGUGGAAGGUCAGUGGGU | 4741 |
| ACUGACCUUCCACACCCAA | 4742 | UUGGGUGUGGAAGGUCAGU | 4743 |
| CUGACCUUCCACACCCAAG | 4744 | CUUGGGUGUGGAAGGUCAG | 4745 |
| GGGUGGUUCUUGGAAGCAG | 4746 | CUGCUUCCAAGAACCACCC | 4747 |
| GGUGGUUCUUGGAAGCAGA | 4748 | UCUGCUUCCAAGAACCACC | 4749 |
| GUGGUUCUUGGAAGCAGAG | 4750 | CUCUGCUUCCAAGAACCAC | 4751 |
| UGGUUCUUGGAAGCAGAGC | 4752 | GCUCUGCUUCCAAGAACCA | 4753 |
| GGUUCUUGGAAGCAGAGCU | 4754 | AGCUCUGCUUCCAAGAACC | 4755 |
| GUUCUUGGAAGCAGAGCUA | 4756 | UAGCUCUGCUUCCAAGAAC | 4757 |
| UUCUUGGAAGCAGAGCUAG | 4758 | CUAGCUCUGCUUCCAAGAA | 4759 |
| CUUGGAAGCAGAGCUAGGA | 4760 | UCCUAGCUCUGCUUCCAAG | 4761 |
| UGGAAGCAGAGCUAGGAUG | 4762 | CAUCCUAGCUCUGCUUCCA | 4763 |
| GGAAGCAGAGCUAGGAUGU | 4764 | ACAUCCUAGCUCUGCUUCC | 4765 |
| AGCUAGGAUGUGGGAGGUC | 4766 | GACCUCCCACAUCCUAGCU | 4767 |
| GCUAGGAUGUGGGAGGUCU | 4768 | AGACCUCCCACAUCCUAGC | 4769 |
| CUAGGAUGUGGGAGGUCUG | 4770 | CAGACCUCCCACAUCCUAG | 4771 |
| UAGGAUGUGGGAGGUCUGC | 4772 | GCAGACCUCCCACAUCCUA | 4773 |
| AGGAUGUGGGAGGUCUGCC | 4774 | GGCAGACCUCCCACAUCCU | 4775 |
| GGAUGUGGGAGGUCUGCCU | 4776 | AGGCAGACCUCCCACAUCC | 4777 |
| GAUGUGGGAGGUCUGCCUG | 4778 | CAGGCAGACCUCCCACAUC | 4779 |
| AUGUGGGAGGUCUGCCUGU | 4780 | ACAGGCAGACCUCCCACAU | 4781 |
| UUUCCUUGUCAUGCUUCCU | 4782 | AGGAAGCAUGACAAGGAAA | 4783 |
| UUCCUUGUCAUGCUUCCUC | 4784 | GAGGAAGCAUGACAAGGAA | 4785 |
| UGUCAUGCUUCCUCCUCUU | 4786 | AAGAGGAGGAAGCAUGACA | 4787 |
| UCAUGCUUCCUCCUCUUUC | 4788 | GAAAGAGGAGGAAGCAUGA | 4789 |
| CUUCCUCCUCUUUCUCAUA | 4790 | UAUGAGAAAGAGGAGGAAG | 4791 |
| UCCUCCUCUUUCUCAUAAA | 4792 | UUUAUGAGAAAGAGGAGGA | 4793 |
| CCUCCUCUUUCUCAUAAAA | 4794 | UUUUAUGAGAAAGAGGAGG | 4795 |
| UCACGAUGGCAAUGCAAAU | 4796 | AUUUGCAUUGCCAUCGUGA | 4797 |
| CACGAUGGCAAUGCAAAUC | 4798 | GAUUUGCAUUGCCAUCGUG | 4799 |
| ACGAUGGCAAUGCAAAUCU | 4800 | AGAUUUGCAUUGCCAUCGU | 4801 |
| CGAUGGCAAUGCAAAUCUA | 4802 | UAGAUUUGCAUUGCCAUCG | 4803 |
| GAUGGCAAUGCAAAUCUAA | 4804 | UUAGAUUUGCAUUGCCAUC | 4805 |
| UGGCAAUGCAAAUCUAAAG | 4806 | CUUUAGAUUUGCAUUGCCA | 4807 |
| GGCAAUGCAAAUCUAAAGA | 4808 | UCUUUAGAUUUGCAUUGCC | 4809 |
| AUGCAAAUCUAAAGAGGCA | 4810 | UGCCUCUUUAGAUUUGCAU | 4811 |
| GCAAAUCUAAAGAGGCAGG | 4812 | CCUGCCUCUUUAGAUUUGC | 4813 |
| CAAAUCUAAAGAGGCAGGG | 4814 | CCCUGCCUCUUUAGAUUUG | 4815 |
| AAAUCUAAAGAGGCAGGGC | 4816 | GCCCUGCCUCUUUAGAUUU | 4817 |
| ACUUCCCUGUCAGGCAGUA | 4818 | UACUGCCUGACAGGGAAGU | 4819 |
| CUUCCCUGUCAGGCAGUAC | 4820 | GUACUGCCUGACAGGGAAG | 4821 |
| UUCCCUGUCAGGCAGUACC | 4822 | GGUACUGCCUGACAGGGAA | 4823 |
| UCCCUGUCAGGCAGUACCG | 4824 | CGGUACUGCCUGACAGGGA | 4825 |
| CCUGUCAGGCAGUACCGCU | 4826 | AGCGGUACUGCCUGACAGG | 4827 |
| CUGUCAGGCAGUACCGCUG | 4828 | CAGCGGUACUGCCUGACAG | 4829 |
| UGUCAGGCAGUACCGCUGG | 4830 | CCAGCGGUACUGCCUGACA | 4831 |
| AGGCAGUACCGCUGGGCAU | 4832 | AUGCCCAGCGGUACUGCCU | 4833 |
| GGCAGUACCGCUGGGCAUA | 4834 | UAUGCCCAGCGGUACUGCC | 4835 |
| GCAGUACCGCUGGGCAUAG | 4836 | CUAUGCCCAGCGGUACUGC | 4837 |
| UACCGCUGGGCAUAGCAAC | 4838 | GUUGCUAUGCCCAGCGGUA | 4839 |
| ACCGCUGGGCAUAGCAACC | 4840 | GGUUGCUAUGCCCAGCGGU | 4841 |
| CCGCUGGGCAUAGCAACCU | 4842 | AGGUUGCUAUGCCCAGCGG | 4843 |
| CCUCUGCCUCUCCGUUUCU | 4844 | AGAAACGGAGAGGCAGAGG | 4845 |
| UGCCUCUCCGUUUCUCAGA | 4846 | UCUGAGAAACGGAGAGGCA | 4847 |
| UCUCCGUUUCUCAGAGCUC | 4848 | GAGCUCUGAGAAACGGAGA | 4849 |
| CUCCGUUUCUCAGAGCUCA | 4850 | UGAGCUCUGAGAAACGGAG | 4851 |
| UCCGUUUCUCAGAGCUCAC | 4852 | GUGAGCUCUGAGAAACGGA | 4853 |
| CCGUUUCUCAGAGCUCACA | 4854 | UGUGAGCUCUGAGAAACGG | 4855 |
| CGUUUCUCAGAGCUCACAU | 4856 | AUGUGAGCUCUGAGAAACG | 4857 |
| UUUCUCAGAGCUCACAUAU | 4858 | AUAUGUGAGCUCUGAGAAA | 4859 |
| AGAGCUCACAUAUCCACCU | 4860 | AGGUGGAUAUGUGAGCUCU | 4861 |
| GAGCUCACAUAUCCACCUC | 4862 | GAGGUGGAUAUGUGAGCUC | 4863 |
| AGCUCACAUAUCCACCUCC | 4864 | GGAGGUGGAUAUGUGAGCU | 4865 |
| CAUAUCCACCUCCUGGGCU | 4866 | AGCCCAGGAGGUGGAUAUG | 4867 |
| AUAUCCACCUCCUGGGCUU | 4868 | AAGCCCAGGAGGUGGAUAU | 4869 |
| UAUCCACCUCCUGGGCUUU | 4870 | AAAGCCCAGGAGGUGGAUA | 4871 |
| AUCCACCUCCUGGGCUUUU | 4872 | AAAAGCCCAGGAGGUGGAU | 4873 |
| UCCACCUCCUGGGCUUUUA | 4874 | UAAAAGCCCAGGAGGUGGA | 4875 |
| CCACCUCCUGGGCUUUUAA | 4876 | UUAAAAGCCCAGGAGGUGG | 4877 |
| UCCUGGGCUUUUAAGUGGG | 4878 | CCCACUUAAAAGCCCAGGA | 4879 |
| CCUGGGCUUUUAAGUGGGC | 4880 | GCCCACUUAAAAGCCCAGG | 4881 |
| CUGGGCUUUUAAGUGGGCU | 4882 | AGCCCACUUAAAAGCCCAG | 4883 |
| UGGGCUUUUAAGUGGGCUU | 4884 | AAGCCCACUUAAAAGCCCA | 4885 |

TABLE 4-continued

| Sense Sequence | SEQ ID NO: | Antisense Sequence | SEQ ID NO: |
|---|---|---|---|
| GGGCUUUUAAGUGGGCUUU | 4886 | AAAGCCCACUUAAAAGCCC | 4887 |
| UUUUAAGUGGGCUUUAGUG | 4888 | CACUAAAGCCCACUUAAAA | 4889 |
| UUUAAGUGGGCUUUAGUGA | 4890 | UCACUAAAGCCCACUUAAA | 4891 |
| UUAAGUGGGCUUUAGUGAG | 4892 | CUCACUAAAGCCCACUUAA | 4893 |
| UAAGUGGGCUUUAGUGAGG | 4894 | CCUCACUAAAGCCCACUUA | 4895 |
| AAGUGGGCUUUAGUGAGGG | 4896 | CCCUCACUAAAGCCCACUU | 4897 |
| GGGCUCCUCCUUCAACUGG | 4898 | CCAGUUGAAGGAGGAGCCC | 4899 |
| GGCUCCUCCUUCAACUGGG | 4900 | CCCAGUUGAAGGAGGAGCC | 4901 |
| GCUCCUCCUUCAACUGGGC | 4902 | GCCCAGUUGAAGGAGGAGC | 4903 |
| CAACUGGGCUCCUCCUUCA | 4904 | UGAAGGAGGAGCCCAGUUG | 4905 |
| AACUGGGCUCCUCCUUCAG | 4906 | CUGAAGGAGGAGCCCAGUU | 4907 |
| UGGGCUCCUCCUUCAGUUC | 4908 | GAACUGAAGGAGGAGCCCA | 4909 |
| GGGCUCCUCCUUCAGUUCC | 4910 | GGAACUGAAGGAGGAGCCC | 4911 |
| CCCAGCUCUUCUGCUUCGA | 4912 | UCGAAGCAGAAGAGCUGGG | 4913 |
| CCAGCUCUUCUGCUUCGAC | 4914 | GUCGAAGCAGAAGAGCUGG | 4915 |
| CAGCUCUUCUGCUUCGACU | 4916 | AGUCGAAGCAGAAGAGCUG | 4917 |
| AGCUCUUCUGCUUCGACUC | 4918 | GAGUCGAAGCAGAAGAGCU | 4919 |
| GCUCUUCUGCUUCGACUCC | 4920 | GGAGUCGAAGCAGAAGAGC | 4921 |
| CUCUUCUGCUUCGACUCCG | 4922 | CGGAGUCGAAGCAGAAGAG | 4923 |
| UCUUCUGCUUCGACUCCGA | 4924 | UCGGAGUCGAAGCAGAAGA | 4925 |
| CUUCUGCUUCGACUCCGAG | 4926 | CUCGGAGUCGAAGCAGAAG | 4927 |
| UUCGACUCCGAGCGGGUGU | 4928 | ACACCCGCUCGGAGUCGAA | 4929 |
| UCCGAGCGGGUGUCAUGUG | 4930 | CACAUGACACCCGCUCGGA | 4931 |
| CCGAGCGGGUGUCAUGUGU | 4932 | ACACAUGACACCCGCUCGG | 4933 |
| CGAGCGGGUGUCAUGUGUG | 4934 | CACACAUGACACCCGCUCG | 4935 |
| GAGCGGGUGUCAUGUGUGA | 4936 | UCACACAUGACACCCGCUC | 4937 |

The inhibitory nucleic acid molecules disclosed herein can comprise RNA, DNA, or both RNA and DNA. The inhibitory nucleic acid molecules can also be linked or fused to a heterologous nucleic acid sequence, such as in a vector, or a heterologous label. For example, the inhibitory nucleic acid molecules disclosed herein can be within a vector or as an exogenous donor sequence comprising the inhibitory nucleic acid molecule and a heterologous nucleic acid sequence. The inhibitory nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed inhibitory nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The inhibitory nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, —O[(CH$_2$)$_n$O]$_m$CH$_3$, —O(CH$_2$)$_n$OCH$_3$, —O(CH$_2$)$_n$NH$_2$, —O(CH$_2$)$_n$CH$_3$, —O(CH$_2$)$_n$—ONH$_2$, and —O(CH$_2$)$_n$ON[(CH$_2$)$_n$CH$_3$)]$_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as CH$_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:
Sense: mN*mN*/i2FN/mN/i2FN/mN/i2FN/mN/i2FN/mN/i2FN/mN/i2FN/mN/i2FN/mN/i2FN/*mN*/32FN/
Antisense: /52FN/*/i2FN/*mN/i2FN/mN/i2FN/mN/i2FN/mN/i2FN/mN/i2FN/mN/i2FN/mN/i2FN/mN/i2FN/mN*N*N wherein: "N" is the base; "2F" is a 2'-F modification; "m" is a 2'-O-methyl modification, "I" is an internal base; and "*" is a phosphorothioate backbone linkage.

The present disclosure also provides vectors comprising any one or more of the inhibitory nucleic acid molecules disclosed herein. In some embodiments, the vectors comprise any one or more of the inhibitory nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

The present disclosure also provides compositions comprising any one or more of the inhibitory nucleic acid molecules disclosed herein. In some embodiments, the composition is a pharmaceutical composition. In some embodiments, the compositions comprise a carrier and/or excipient. Examples of carriers include, but are not limited to, poly (lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

In some embodiments, the INHBE inhibitor comprises a nuclease agent that induces one or more nicks or double-strand breaks at a recognition sequence(s) or a DNA-binding protein that binds to a recognition sequence within an INHBE genomic nucleic acid molecule. The recognition sequence can be located within a coding region of the INHBE gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the INHBE gene. For example, the recognition sequence can be located about 10, about 20, about 30, about 40, about 50, about 100, about 200, about 300, about 400, about 500, or about 1,000 nucleotides from the start codon. As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30-36 bp for a zinc finger protein or ZFN pair, about 15-18 bp for each ZFN, about 36 bp for a TALE protein or TALEN, and about 20 bp for a CRISPR/Cas guide RNA.

In some embodiments, CRISPR/Cas systems can be used to modify an INHBE genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of INHBE nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in an INHBE genomic nucleic acid molecule or it can be a nickase that creates a single-strand break in an INHBE genomic nucleic acid molecule. Additional examples of Cas proteins include, but are not limited to, Cas1, Cas1B, Cast, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. In some embodiments, a Cas system, such as Cas12a, can have multiple gRNAs encoded into a single crRNA. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of INHBE genomic nucleic acid molecules can be generated by contacting a cell with a Cas protein and one or more gRNAs that hybridize to one or more gRNA recognition sequences within a target genomic locus in the INHBE genomic nucleic acid molecule. For example, a gRNA recognition sequence can be located within a region of SEQ ID NO:1. The gRNA recognition sequence can include or be proximate to the start codon of an INHBE genomic nucleic acid molecule or the stop codon of an INHBE genomic nucleic acid molecule. For example, the gRNA recognition sequence can be located from about 10, from about 20, from about 30, from about 40, from about 50, from about 100, from about 200, from about 300, from about 400, from about 500, or from about 1,000 nucleotides of the start codon or the stop codon.

The gRNA recognition sequences within a target genomic locus in an INHBE genomic nucleic acid molecule are located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes PAM. In addition, 5'-NGA-3' can be a highly efficient non-canonical PAM for human cells. Generally, the PAM is about 2-6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10, about 2 to about 5 base pairs, or three base pairs upstream or downstream of the PAM sequence. In some embodiments (such as when Cas9 from *S. pyogenes* or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within an INHBE genomic nucleic acid molecule. An exemplary gRNA is a gRNA effective to direct a Cas enzyme to bind to or cleave an INHBE genomic nucleic acid molecule, wherein the gRNA comprises a DNA-targeting segment that hybridizes to a gRNA recognition sequence within the INHBE genomic nucleic acid molecule. Exemplary gRNAs comprise a DNA-targeting segment that hybridizes to a gRNA recognition sequence present within an INHBE genomic nucleic acid molecule that includes or is proximate to the start codon or the stop codon. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the start codon or located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs can comprise 20 nucleotides.

Examples of suitable gRNA recognition sequences located within the human INHBE reference gene are set forth in Table 5 as SEQ ID NOs:9-27.

TABLE 5

Guide RNA Recognition Sequences Near INHBE Variation(s)

| Strand | gRNA Recognition Sequence | SEQ ID NO: |
|---|---|---|
| - | CGTCTGTTGAGTCTGATTGC | 9 |
| + | GACGGAGCAACTGCCATCCG | 10 |
| - | ATCAGGGAGCCGCATGCTCC | 11 |
| + | CTGAACCAGGGCCATTCACC | 12 |
| - | CCTGGTTCAGGAGCCTCGGA | 13 |
| + | CATCCGAGGCTCCTGAACCA | 14 |
| + | CCATCCGAGGCTCCTGAACC | 15 |
| - | GCCACCTGTCTTCTATTGTC | 16 |
| - | AGCCGCATGCTCCTGGTGAA | 17 |
| - | GTCTGTTGAGTCTGATTGCT | 18 |
| + | AAGACAGGTGGCTGTACCCT | 19 |
| - | CTGATTGCTGGGGCCAATG | 20 |
| - | TGATTGCTGGGGCCAATGA | 21 |
| - | CCACCTGTCTTCTATTGTCT | 22 |
| - | ATGCTCCTGGTGAATGGCCC | 23 |
| - | CTGTTGAGTCTGATTGCTGG | 24 |
| - | CTGGTGAATGGCCCTGGTTC | 25 |
| - | ACCACTGCCACACCTACCCT | 26 |
| - | TCTGTTGAGTCTGATTGCTG | 27 |

The Cas protein and the gRNA form a complex, and the Cas protein cleaves the target INHBE genomic nucleic acid molecule. The Cas protein can cleave the nucleic acid molecule at a site within or outside of the nucleic acid sequence present in the target INHBE genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the INHBE genomic nucleic acid molecule to which a DNA-targeting segment of a gRNA will bind.

Such methods can result, for example, in an INHBE genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the INHBE genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

The methods and compositions disclosed herein can utilize exogenous donor sequences (e.g., targeting vectors or repair templates) to modify an INHBE gene, either without cleavage of the INHBE gene or following cleavage of the INHBE gene with a nuclease agent. An exogenous donor sequence refers to any nucleic acid or vector that includes the elements that are required to enable site-specific recombination with a target sequence. Using exogenous donor sequences in combination with nuclease agents may result in more precise modifications within the INHBE gene by promoting homology-directed repair.

In such methods, the nuclease agent cleaves the INHBE gene to create a single-strand break (nick) or double-strand break, and the exogenous donor sequence recombines the INHBE gene via non-homologous end joining (NHEJ)-mediated ligation or through a homology-directed repair event. Optionally, repair with the exogenous donor sequence removes or disrupts the nuclease cleavage site so that alleles that have been targeted cannot be re-targeted by the nuclease agent.

Exogenous donor sequences can comprise deoxyribonucleic acid (DNA) or ribonucleic acid (RNA), they can be single-stranded or double-stranded, and they can be in linear or circular form. For example, an exogenous donor sequence can be a single-stranded oligodeoxynucleotide (ssODN). See, e.g., Yoshimi et al., Nat. Commun., 2016, 7, 10431. An exemplary exogenous donor sequence is from about 50 nucleotides to about 5 kb in length, from about 50 nucleotides to about 3 kb in length, or from about 50 to about 1,000 nucleotides in length. Other exemplary exogenous donor sequences are from about 40 to about 200 nucleotides in length. For example, an exogenous donor sequence can be from about 50 to about 60, from about 60 to about 70, from about 70 to about 80, from about 80 to about 90, from about 90 to about 100, from about 100 to about 110, from about 110 to about 120, from about 120 to about 130, from about 130 to about 140, from about 140 to about 150, from about 150 to about 160, from about 160 to about 170, from about 170 to about 180, from about 180 to about 190, or from about 190 to about 200 nucleotides in length. Alternately, an exogenous donor sequence can be from about 50 to about 100, from about 100 to about 200, from about 200 to about 300, from about 300 to about 400, from about 400 to about 500, from about 500 to about 600, from about 600 to about 700, from about 700 to about 800, from about 800 to about 900, or from about 900 to about 1,000 nucleotides in length. Alternately, an exogenous donor sequence can be from about 1 kb to about 1.5 kb, from about 1.5 kb to about 2 kb, from about 2 kb to about 2.5 kb, from about 2.5 kb to about 3 kb, from about 3 kb to about 3.5 kb, from about 3.5 kb to about 4 kb, from about 4 kb to about 4.5 kb, or from about 4.5 kb to about 5 kb in length. Alternately, an exogenous donor sequence can be, for example, no more than 5 kb, 4.5 kb, 4 kb, 3.5 kb, 3 kb, 2.5 kb, 2 kb, 1.5 kb, 1 kb, 900 nucleotides, 800 nucleotides, 700 nucleotides, 600 nucleotides, 500 nucleotides, 400 nucleotides, 300 nucleotides, 200 nucleotides, 100 nucleotides, or 50 nucleotides in length.

In some examples, an exogenous donor sequence is an ssODN that is from about 80 nucleotides and about 200 nucleotides in length (e.g., about 120 nucleotides in length). In another example, an exogenous donor sequences is an ssODN that is from about 80 nucleotides and about 3 kb in length. Such an ssODN can have homology arms, for example, that are each from about 40 nucleotides and about 60 nucleotides in length. Such an ssODN can also have homology arms, for example, that are each from about 30 nucleotides and 100 nucleotides in length. The homology arms can be symmetrical (e.g., each 40 nucleotides or each 60 nucleotides in length), or they can be asymmetrical (e.g., one homology arm that is 36 nucleotides in length, and one homology arm that is 91 nucleotides in length).

Exogenous donor sequences can include modifications or sequences that provide for additional desirable features (e.g., modified or regulated stability; tracking or detecting with a fluorescent label; a binding site for a protein or protein complex; and so forth). Exogenous donor sequences can comprise one or more fluorescent labels, purification tags, epitope tags, or a combination thereof. For example, an exogenous donor sequence can comprise one or more fluorescent labels (e.g., fluorescent proteins or other fluorophores or dyes), such as at least 1, at least 2, at least 3, at least 4, or at least 5 fluorescent labels. Exemplary fluorescent labels include fluorophores such as fluorescein (e.g., 6-carboxyfluorescein (6-FAM)), Texas Red, HEX, Cy3, Cy5, Cy5.5, Pacific Blue, 5-(and-6)-carboxytetramethylrhodamine (TAMRA), and Cy7. A wide range of fluorescent dyes are available commercially for labeling oligonucleotides (e.g., from Integrated DNA Technologies). Such fluorescent labels (e.g., internal fluorescent labels) can be used, for example, to detect an exogenous donor sequence that has been directly integrated into a cleaved INHBE gene having protruding ends compatible with the ends of the exogenous donor sequence. The label or tag can be at the 5' end, the 3' end, or internally within the exogenous donor sequence. For example, an exogenous donor sequence can be conjugated at 5' end with the IR700 fluorophore from Integrated DNA Technologies (5'IRDYE® 700). Exogenous donor sequences can also comprise nucleic acid inserts including segments of DNA to be integrated in the INHBE gene. Integration of a nucleic acid insert in the INHBE gene can result in addition of a nucleic acid sequence of interest in the INHBE gene, deletion of a nucleic acid sequence of interest in the INHBE gene, or replacement of a nucleic acid sequence of interest in the INHBE gene (i.e., deletion and insertion). Some exogenous donor sequences are designed for insertion of a nucleic acid insert in the INHBE gene without any corresponding deletion in the INHBE gene. Other exogenous donor sequences are designed to delete a nucleic acid sequence of interest in the INHBE gene without any corresponding insertion of a nucleic acid insert. Yet other exogenous donor sequences are designed to delete a nucleic acid sequence of interest in the INHBE gene and replace it with a nucleic acid insert.

The nucleic acid insert or the corresponding nucleic acid in the INHBE gene being deleted and/or replaced can be various lengths. An exemplary nucleic acid insert or corresponding nucleic acid in the INHBE gene being deleted and/or replaced is from about 1 nucleotide to about 5 kb in length or is from about 1 nucleotide to about 1,000 nucleotides in length. For example, a nucleic acid insert or a corresponding nucleic acid in the INHBE gene being deleted and/or replaced can be from about 1 to about 10, from about 10 to about 20, from about 20 to about 30, from about 30 to about 40, from about 40 to about 50, from about 50 to about 60, from about 60 to about 70, from about 70 to about 80, from about 80 to about 90, from about 90 to about 100, from about 100 to about 110, from about 110 to about 120, from about 120 to about 130, from about 130 to about 140, from about 140 to about 150, from about 150 to about 160, from about 160 to about 170, from about 170 to about 180, from about 180 to about 190, or from about 190 to about 200 nucleotides in length. Likewise, a nucleic acid insert or a corresponding nucleic acid in the INHBE gene being deleted and/or replaced can be from about 1 to about 100, from about 100 to about 200, from about 200 to about 300, from about 300 to about 400, from about 400 to about 500, from about 500 to about 600, from about 600 to about 700, from about 700 to about 800, from about 800 to about 900, or from about 900 to about 1,000 nucleotides in length. Likewise, a nucleic acid insert or a corresponding nucleic acid in the INHBE gene being deleted and/or replaced can be from about 1 kb to about 1.5 kb, from about 1.5 kb to about 2 kb, from about 2 kb to about 2.5 kb, from about 2.5 kb to about 3 kb, from about 3 kb to about 3.5 kb, from about 3.5 kb to about 4 kb, from about 4 kb to about 4.5 kb, or from about 4.5 kb to about 5 kb in length.

The nucleic acid insert can comprise genomic DNA or any other type of DNA. For example, the nucleic acid insert can comprise cDNA.

The nucleic acid insert can comprise a sequence that is homologous to all or part of the INHBE gene (e.g., a portion of the gene encoding a particular motif or region of an INHBE protein). For example, the nucleic acid insert can comprise a sequence that comprises one or more point mutations (e.g., 1, 2, 3, 4, 5, or more) or one or more nucleotide insertions or deletions compared with a sequence targeted for replacement in the INHBE gene. The nucleic acid insert or the corresponding nucleic acid in the INHBE gene being deleted and/or replaced can be a coding region such as an exon; a non-coding region such as an intron, an untranslated region, or a regulatory region (e.g., a promoter, an enhancer, or a transcriptional repressor-binding element); or any combination thereof.

The nucleic acid insert can also comprise a conditional allele. The conditional allele can be a multifunctional allele, as described in US 2011/0104799. For example, the conditional allele can comprise: a) an actuating sequence in sense orientation with respect to transcription of a target gene; b) a drug selection cassette (DSC) in sense or antisense orientation; c) a nucleotide sequence of interest (NSI) in antisense orientation; and d) a conditional by inversion module (COIN, which utilizes an exon-splitting intron and an invertible gene-trap-like module) in reverse orientation. See, e.g., US 2011/0104799. The conditional allele can further comprise recombinable units that recombine upon exposure to a first recombinase to form a conditional allele that i) lacks the actuating sequence and the DSC; and ii) contains the NSI in sense orientation and the COIN in antisense orientation. See, e.g., US 2011/0104799.

Nucleic acid inserts can also comprise a polynucleotide encoding a selection marker. Alternately, the nucleic acid inserts can lack a polynucleotide encoding a selection marker. The selection marker can be contained in a selection cassette. Optionally, the selection cassette can be a self-deleting cassette. See, e.g., U.S. Pat. No. 8,697,851 and US 2013/0312129. As an example, the self-deleting cassette can comprise a Cre gene (comprises two exons encoding a Cre recombinase, which are separated by an intron) operably linked to a mouse Prm1 promoter and a neomycin resistance gene operably linked to a human ubiquitin promoter. Exemplary selection markers include neomycin phosphotransferase ($neo^r$), hygromycin B phosphotransferase ($hyg^r$), puromycin-N-acetyltransferase ($puro^r$), blasticidin S deaminase ($bsr^r$), xanthine/guanine phosphoribosyl transferase (gpt), or herpes simplex virus thymidine kinase (HSV-k), or a combination thereof. The polynucleotide encoding the selection marker can be operably linked to a promoter active in a cell being targeted. Examples of promoters are described elsewhere herein.

The nucleic acid insert can also comprise a reporter gene. Exemplary reporter genes include those encoding luciferase, β-galactosidase, green fluorescent protein (GFP), enhanced green fluorescent protein (eGFP), cyan fluorescent protein (CFP), yellow fluorescent protein (YFP), enhanced yellow fluorescent protein (eYFP), blue fluorescent protein (BFP), enhanced blue fluorescent protein (eBFP), DsRed, ZsGreen, MmGFP, mPlum, mCherry, tdTomato, mStrawberry, J-Red, mOrange, mKO, mCitrine, Venus, YPet, Emerald, CyPet, Cerulean, T-Sapphire, and alkaline phosphatase. Such reporter genes can be operably linked to a promoter active in a cell being targeted. Examples of promoters are described elsewhere herein.

The nucleic acid insert can also comprise one or more expression cassettes or deletion cassettes. A given cassette can comprise one or more of a nucleotide sequence of interest, a polynucleotide encoding a selection marker, and a reporter gene, along with various regulatory components that influence expression. Examples of selectable markers and reporter genes that can be included are discussed in detail elsewhere herein. The nucleic acid insert can comprise a nucleic acid flanked with site-specific recombination target sequences. Alternately, the nucleic acid insert can comprise one or more site-specific recombination target sequences. Although the entire nucleic acid insert can be flanked by such site-specific recombination target sequences, any region or individual polynucleotide of interest within the nucleic acid insert can also be flanked by such sites. Site-specific recombination target sequences, which can flank the nucleic acid insert or any polynucleotide of interest in the nucleic acid insert can include, for example, loxP, lox511, lox2272, lox66, lox71, loxM2, lox5171, FRT, FRT11, FRT71, attp, att, FRT, rox, or a combination thereof. In some examples, the site-specific recombination sites flank a polynucleotide encoding a selection marker and/or a reporter gene contained within the nucleic acid insert. Following integration of the nucleic acid insert in the INHBE gene, the sequences between the site-specific recombination sites can be removed. Optionally, two exogenous donor sequences can be used, each with a nucleic acid insert comprising a site-specific recombination site. The exogenous donor sequences can be targeted to 5' and 3' regions flanking a nucleic acid of interest. Following integration of the two nucleic acid inserts into the target genomic locus, the nucleic acid of interest between the two inserted site-specific recombination sites can be removed.

Nucleic acid inserts can also comprise one or more restriction sites for restriction endonucleases (i.e., restriction enzymes), which include Type I, Type II, Type III, and Type IV endonucleases. Type I and Type III restriction endonucleases recognize specific recognition sequences, but typically cleave at a variable position from the nuclease binding site, which can be hundreds of base pairs away from the cleavage site (recognition sequence). In Type II systems the restriction activity is independent of any methylase activity, and cleavage typically occurs at specific sites within or near to the binding site. Most Type II enzymes cut palindromic sequences, however Type IIa enzymes recognize non-palindromic recognition sequences and cleave outside of the recognition sequence, Type IIb enzymes cut sequences twice with both sites outside of the recognition sequence, and Type IIs enzymes recognize an asymmetric recognition sequence and cleave on one side and at a defined distance of about 1-20 nucleotides from the recognition sequence. Type IV restriction enzymes target methylated DNA. Restriction enzymes are further described and classified, for example in the REBASE database (webpage at rebase.neb.com; Roberts et al., Nucleic Acids Res., 2003, 31, 418-420; Roberts et al., Nucleic Acids Res., 2003, 31, 1805-1812; and Belfort et al., in Mobile DNA II, 2002, pp. 761-783, Eds. Craigie et al., (ASM Press, Washington, D.C.)).

Some exogenous donor sequences have short single-stranded regions at the 5' end and/or the 3' end that are complementary to one or more overhangs created by nuclease-mediated or Cas-protein-mediated cleavage at the target genomic locus (e.g., in the INHBE gene). These overhangs can also be referred to as 5' and 3' homology arms. For example, some exogenous donor sequences have short single-stranded regions at the 5' end and/or the 3' end that are complementary to one or more overhangs created by Cas-protein-mediated cleavage at 5' and/or 3' target sequences at the target genomic locus. Some such exogenous donor sequences have a complementary region only at the 5' end or only at the 3' end. For example, some such exogenous donor sequences have a complementary region only at the 5' end complementary to an overhang created at a 5' target sequence at the target genomic locus or only at the 3' end complementary to an overhang created at a 3' target sequence at the target genomic locus. Other such exogenous donor sequences have complementary regions at both the 5' and 3' ends. For example, other such exogenous donor sequences have complementary regions at both the 5' and 3' ends e.g., complementary to first and second overhangs, respectively, generated by Cas-mediated cleavage at the target genomic locus. For example, if the exogenous donor sequence is double-stranded, the single-stranded complementary regions can extend from the 5' end of the top strand of the donor sequence and the 5' end of the bottom strand of the donor sequence, creating 5' overhangs on each end. Alternately, the single-stranded complementary region can extend from the 3' end of the top strand of the donor sequence and from the 3' end of the bottom strand of the template, creating 3' overhangs.

The complementary regions can be of any length sufficient to promote ligation between the exogenous donor sequence and the INHBE gene. Exemplary complementary regions are from about 1 to about 5 nucleotides in length, from about 1 to about 25 nucleotides in length, or from about 5 to about 150 nucleotides in length. For example, a complementary region can be at least about 1, 2, 3, 4, 5, 6, 7, 8, 9, 10, 11, 12, 13, 14, 15, 16, 17, 18, 19, 20, 21, 22, 23, 24, or 25 nucleotides in length. Alternately, the complementary region can be from about 5 to about 10, from about 10 to about 20, from about 20 to about 30, from about 30 to about 40, from about 40 to about 50, from about 50 to about 60, from about 60 to about 70, from about 70 to about 80, from about 80 to about 90, from about 90 to about 100, from about 100 to about 110, from about 110 to about 120, from about 120 to about 130, from about 130 to about 140, from about 140 to about 150 nucleotides in length, or longer.

Such complementary regions can be complementary to overhangs created by two pairs of nickases. Two double-strand breaks with staggered ends can be created by using first and second nickases that cleave opposite strands of DNA to create a first double-strand break, and third and fourth nickases that cleave opposite strands of DNA to create a second double-strand break. For example, a Cas protein can be used to nick first, second, third, and fourth guide RNA recognition sequences corresponding with first, second, third, and fourth guide RNAs. The first and second guide RNA recognition sequences can be positioned to create a first cleavage site such that the nicks created by the first and second nickases on the first and second strands of DNA create a double-strand break (i.e., the first cleavage site comprises the nicks within the first and second guide RNA recognition sequences). Likewise, the third and fourth guide RNA recognition sequences can be positioned to create a second cleavage site such that the nicks created by the third and fourth nickases on the first and second strands of DNA create a double-strand break (i.e., the second cleavage site comprises the nicks within the third and fourth guide RNA recognition sequences). Preferably, the nicks within the first and second guide RNA recognition sequences and/or the third and fourth guide RNA recognition sequences can be off-set nicks that create overhangs. The offset window can be, for example, at least about 5 bp, 10 bp, 20 bp, 30 bp, 40 bp, 50 bp, 60 bp, 70 bp, 80 bp, 90 bp, 100 bp or more. See, Ran et al., Cell, 2013, 154, 1380-1389; Mali et al., Nat. Biotech., 2013, 31, 833-838; and Shen et al., Nat. Methods, 2014, 11, 399-404. In such cases, a double-stranded exogenous donor sequence can be designed with single-stranded complementary regions that are complementary to the overhangs created by the nicks within the first and second guide RNA recognition sequences and by the nicks within the third and fourth guide RNA recognition sequences. Such an exogenous donor sequence can then be inserted by non-homologous-end-joining-mediated ligation.

Some exogenous donor sequences (i.e., targeting vectors) comprise homology arms. If the exogenous donor sequence also comprises a nucleic acid insert, the homology arms can flank the nucleic acid insert. For ease of reference, the homology arms are referred to herein as 5' and 3' (i.e., upstream and downstream) homology arms. This terminology relates to the relative position of the homology arms to the nucleic acid insert within the exogenous donor sequence. The 5' and 3' homology arms correspond to regions within the INHBE gene, which are referred to herein as "5' target sequence" and "3' target sequence," respectively.

A homology arm and a target sequence "correspond" or are "corresponding" to one another when the two regions share a sufficient level of sequence identity to one another to act as substrates for a homologous recombination reaction. The term "homology" includes DNA sequences that are either identical or share sequence identity to a corresponding sequence. The sequence identity between a given target sequence and the corresponding homology arm found in the exogenous donor sequence can be any degree of sequence identity that allows for homologous recombination to occur. For example, the amount of sequence identity shared by the homology arm of the exogenous donor sequence (or a fragment thereof) and the target sequence (or a fragment thereof) can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination. Moreover, a corresponding region of homology between the homology arm and the corresponding target sequence can be of any length that is sufficient to promote homologous recombination. Exemplary homology arms are from about 25 nucleotides to about 2.5 kb in length, are from about 25 nucleotides to about 1.5 kb in length, or are from about 25 to about 500 nucleotides in length. For example, a given homology arm (or each of the homology arms) and/or corresponding target sequence can comprise corresponding regions of homology that are from about 25 to about 30, from about 30 to about 40, from about 40 to about 50, from about 50 to about 60, from about 60 to about 70, from about 70 to about 80, from about 80 to about 90, from about 90 to about 100, from about 100 to about 150, from about 150 to about 200, from about 200 to about 250, from about 250 to about 300, from about 300 to about 350, from about 350 to about 400, from about 400 to about 450, or from about 450 to about 500 nucleotides in length, such that the homology arms have sufficient homology to undergo homologous recombination with the corresponding target sequences within the INHBE gene. Alternately, a given homology arm (or each homology arm) and/or corresponding target sequence can comprise corresponding regions of homology that are from about 0.5 kb to about 1 kb, from about 1 kb to about 1.5 kb, from about 1.5 kb to about 2 kb, or from about 2 kb to about 2.5 kb in length. For example, the homology arms can each be about 750 nucleotides in length. The homology arms can be symmetrical (each about the same size in length), or they can be asymmetrical (one longer than the other).

The homology arms can correspond to a locus that is native to a cell (e.g., the targeted locus). Alternately, for example, they can correspond to a region of a heterologous or exogenous segment of DNA that was integrated into the genome of the cell, including, for example, transgenes, expression cassettes, or heterologous or exogenous regions of DNA. Alternately, the homology arms of the targeting vector can correspond to a region of a yeast artificial chromosome (YAC), a bacterial artificial chromosome (BAC), a human artificial chromosome, or any other engineered region contained in an appropriate host cell. Still further, the homology arms of the targeting vector can correspond to or be derived from a region of a BAC library, a cosmid library, or a P1 phage library, or can be derived from synthetic DNA.

When a nuclease agent is used in combination with an exogenous donor sequence, the 5' and 3' target sequences are preferably located in sufficient proximity to the nuclease cleavage site so as to promote the occurrence of a homologous recombination event between the target sequences and the homology arms upon a single-strand break (nick) or double-strand break at the nuclease cleavage site. The term "nuclease cleavage site" includes a DNA sequence at which a nick or double-strand break is created by a nuclease agent (e.g., a Cas9 protein complexed with a guide RNA). The target sequences within the INHBE gene that correspond to the 5' and 3' homology arms of the exogenous donor sequence are "located in sufficient proximity" to a nuclease cleavage site if the distance is such as to promote the occurrence of a homologous recombination event between the 5' and 3' target sequences and the homology arms upon a single-strand break or double-strand break at the nuclease cleavage site. Thus, the target sequences corresponding to the 5' and/or 3' homology arms of the exogenous donor sequence can be, for example, within at least 1 nucleotide of a given nuclease cleavage site or within at least 10 nucleotides to about 1,000 nucleotides of a given nuclease cleavage site. As an example, the nuclease cleavage site can be immediately adjacent to at least one or both of the target sequences.

The spatial relationship of the target sequences that correspond to the homology arms of the exogenous donor sequence and the nuclease cleavage site can vary. For example, target sequences can be located 5' to the nuclease cleavage site, target sequences can be located 3' to the nuclease cleavage site, or the target sequences can flank the nuclease cleavage site.

Also provided are therapeutic methods and methods of treatment or prophylaxis of a metabolic disorder in a subject having or at risk for the disease using the methods disclosed herein for modifying or altering expression of an endogenous INHBE gene. Also provided are therapeutic methods and methods of treatment or prophylaxis of a metabolic disorder in a subject having or at risk for the disease using methods for decreasing expression of INHBE mRNA transcripts or using methods for providing recombinant nucleic acids encoding INHBE proteins, providing mRNAs encoding INHBE proteins, or providing INHBE proteins to the subject. The methods can comprise introducing one or more nucleic acids or proteins into the subject, into the liver of the subject, or into a cell (e.g., liver cell) of the subject (e.g., in vivo or ex vivo).

Also provided are therapeutic methods and methods of treatment or prophylaxis of a cardiovascular disease in a subject having or at risk for cardiovascular disease using the methods disclosed herein for modifying or altering expression of an endogenous INHBE gene. Also provided are therapeutic methods and methods of treatment or prophylaxis of a cardiovascular disease in a subject having or at risk for cardiovascular disease using methods for decreasing expression of INHBE mRNA transcripts or using methods for providing recombinant nucleic acids encoding INHBE proteins, providing mRNAs encoding INHBE proteins, or providing INHBE proteins to the subject. The methods can comprise introducing one or more nucleic acids or proteins into the subject, into the liver of the subject, or into a cell (e.g., liver cell) of the subject (e.g., in vivo or ex vivo).

Such methods can comprise genome editing or gene therapy. For example, an endogenous INHBE gene that does not encode a loss-of-function variant can be modified to comprise any of the loss-of-function variants described herein. As another example, an endogenous INHBE gene that does not encode a loss-of-function variant can be knocked out or inactivated. Likewise, an endogenous INHBE gene that does not encode a loss-of-function variant can be knocked out or inactivated, and an INHBE gene comprising any one of or any combination of the INHBE loss-of-function variants described herein can be introduced and expressed. Similarly, an endogenous INHBE gene that does not encode a loss-of-function variant can be knocked out or inactivated, and a recombinant DNA encoding any one of or any combination of the INHBE loss-of-function variants described herein can be introduced and expressed, an mRNA encoding any one of or any combination of INHBE loss-of-function variants described herein (or fragments thereof) can be introduced and expressed (e.g., intracellular protein replacement therapy), or a cDNA encoding any one of or any combination of INHBE loss-of-function variants described herein (or fragments thereof) can be introduced (e.g., protein replacement therapy).

Other such methods can comprise introducing and expressing a recombinant INHBE gene comprising any one of or any combination of INHBE loss-of-function variants described herein (e.g., the full INHBE variant or a minigene comprising the modification), introducing and expressing recombinant nucleic acids (e.g., DNA) encoding any one of or any combination of INHBE loss-of-function variants described herein or fragments thereof, introducing and expressing one or more mRNAs encoding any one of or any combination of INHBE loss-of-function variants described herein fragments thereof (e.g., intracellular protein replacement therapy), or introducing any one of or any combination of INHBE loss-of-function variants described herein (e.g., protein replacement therapy) without knocking out or inactivating an endogenous INHBE gene that does not encode a loss-of-function variant.

An INHBE gene or minigene or a DNA encoding any one of or any combination of INHBE loss-of-function variants described herein or fragments thereof can be introduced and expressed in the form of an expression vector that does not modify the genome, it can be introduced in the form of a targeting vector such that it genomically integrates into an INHBE locus, or it can be introduced such that it genomically integrates into a locus other than the INHBE locus, such as a safe harbor locus. The genomically integrated INHBE gene can be operably linked to an INHBE promoter or to another promoter, such as an endogenous promoter at the site of integration. Safe harbor loci are chromosomal sites where transgenes can be stably and reliably expressed in all tissues of interest without adversely affecting gene structure or expression. Safe harbor loci can have, for example, one or more or all of the following characteristics: distance of greater than 50 kb from the 5' end of any gene; distance of greater than 300 kb from any cancer-related gene; distance of greater than 300 kb from any microRNA; outside a gene transcription unit, and outside of ultra-conserved regions. Examples of suitable safe harbor loci include adeno-associated virus site 1 (AAVS1), the chemokine (CC motif) receptor 5 (CCR5) gene locus, and the human orthologue of mouse ROSA26 locus.

Combinations of INHBE protein isoforms or nucleic acids encoding INHBE protein isoforms that can be introduced and expressed include, any one or any combination of protein or mRNA isoforms described herein. For example, INHBE a nucleic acid encoding Isoform 1 (SEQ ID NO:2) encoding any one or any combination of loss-of-function variants described herein (alone or in combination with other isoforms) is introduced or expressed. Exemplary sequences for each of these isoforms and transcripts are provided elsewhere herein. It is understood, however, that gene sequences and within a population, mRNA sequences transcribed from such genes, and proteins translated from such mRNAs can vary due to polymorphisms such as single-nucleotide polymorphisms. The sequences provided herein for each transcript and isoform are only exemplary sequences. Other sequences are also possible.

In some embodiments, the methods comprise treating a subject who is not a carrier of any of the INHBE variant nucleic acid molecules described herein (or is only a heterozygous carrier of any one or any combination of the variant nucleic acid molecules described herein) and has or is susceptible to developing a metabolic disorder and/or a cardiovascular disease, comprising introducing into the subject or introducing into a liver cell in the subject: a) a nuclease agent (or nucleic acid encoding) that binds to a nuclease recognition sequence within an INHBE gene, wherein the nuclease recognition sequence includes or is proximate to a position of one of the INHBE variant nucleic acid molecules described herein; and b) an exogenous donor sequence comprising a 5' homology arm that hybridizes to a target sequence 5' of the position of one of the INHBE variant nucleic acid molecules described herein, a 3' homology arm that hybridizes to a target sequence 3' of the same INHBE variant nucleic acid molecule, and a nucleic acid insert comprising one or more of the variant nucleotides flanked by the 5' homology arm and the 3' homology arm. The nuclease agent can cleave the INHBE gene in a liver cell in the subject, and the exogenous donor sequence can recombine with the INHBE gene in the liver cell, wherein upon recombination of the exogenous donor sequence with the INHBE gene the nucleic acid insert encoding the loss-of-function variant is introduced, substituting the wild type nucleotide. Examples of nuclease agents (e.g., a Cas9 protein and a guide RNA) that can be used in such methods are disclosed elsewhere herein. Examples of suitable guide RNAs and guide RNA recognition sequences are disclosed elsewhere herein. Examples of exogenous donor sequences that can be used in such methods are disclosed elsewhere herein.

As another example, the methods can comprise treating a subject who is not a carrier of any of the INHBE variant nucleic acid molecules described herein (or is only a heterozygous carrier of any one or any combination of the variant nucleic acid molecules described herein) and has or is susceptible to developing a metabolic disorder and/or a cardiovascular disease, comprising introducing into the subject or introducing into a liver cell in the subject an exogenous donor sequence comprising a 5' homology arm that hybridizes to a target sequence 5' of the position of one of the INHBE variant nucleic acid molecules described herein, a 3' homology arm that hybridizes to a target sequence 3' of the same INHBE variant nucleic acid molecule, and a nucleic acid insert comprising one or more of the variant nucleotides flanked by the 5' homology arm and the 3' homology arm. The exogenous donor sequence can recombine with the INHBE gene in the liver cell, wherein upon recombination of the exogenous donor sequence with the INHBE gene the nucleic acid insert encoding the loss-of-function variant is introduced, substituting the wild type nucleotide. Examples of exogenous donor sequences that can be used in such methods are disclosed elsewhere herein.

In some embodiments, the methods comprise treating a subject who is not a carrier of any of the INHBE variant nucleic acid molecules described herein (or is only a heterozygous carrier of any one or any combination of the variant nucleic acid molecules described herein) and has or is susceptible to developing a metabolic disorder and/or a cardiovascular disease, comprising introducing into the subject or introducing into a liver cell in the subject: a) a nuclease agent (or nucleic acid encoding) that binds to a nuclease recognition sequence within an INHBE gene, wherein the nuclease recognition sequence comprises the start codon for the INHBE gene or is within about 10, 20, 30, 40, 50, 100, 200, 300, 400, 500, or 1,000 nucleotides of the start codon. The nuclease agent can cleave and disrupt expression of the INHBE gene in a liver cell in the subject. In some embodiments, the methods comprise treating a subject who is not a carrier of any of the INHBE variant nucleic acid molecules described herein (or is only a heterozygous carrier of any one or any combination of the INHBE variant nucleic acid molecules described herein) and has or is susceptible to developing a metabolic disorder and/or a cardiovascular disease, comprising introducing into the subject or introducing into a liver cell in the subject: a) a nuclease agent (or nucleic acid encoding) that binds to a nuclease recognition sequence within an INHBE gene, wherein the nuclease recognition sequence comprises the start codon for the INHBE gene or is within about 10, 20, 30, 40, 50, 100, 200, 300, 400, 500, or 1,000 nucleotides of the start codon or is selected from SEQ ID NOs: 1-7; and b) an expression vector comprising a recombinant INHBE gene comprising any one or any combination of loss-of-function variants described herein. The expression vector can be one that does not genomically integrate. Alternately, a targeting vector (i.e., exogenous donor sequence) can be introduced comprising a recombinant INHBE gene comprising any one or any combination of loss-of-function variants described herein. The nuclease agent can cleave and disrupt expression of the INHBE gene in a liver cell in the subject, and the expression vector can express the recombinant INHBE gene in the liver cell in the subject. Alternately, the genomically integrated, recombinant INHBE gene can express in the liver cell in the subject. Examples of nuclease agents (e.g., a nuclease-active Cas9 protein and guide RNA) that can be used in such methods are disclosed elsewhere herein. Examples of suitable guide RNAs and guide RNA recognition sequences are disclosed elsewhere herein. Step b) can Alternately comprise introducing an expression vector or targeting vector comprising a nucleic acid (e.g., DNA) encoding an INHBE protein that is at least 90%, at least 95%, at least 96%, at least 97%, at least 98%, at least 99%, or 100% identical to any INHBE isoform described herein or a fragment thereof and comprising any one or any combination of the INHBE variant nucleic acid molecules described herein. Likewise, step b) can alternately comprise introducing an mRNA encoding an INHBE protein that is at least 90%, at least 95%, at least 96%, at least 97%, at least 98%, at least 99%, or 100% identical to any INHBE mRNA isoform described herein or a fragment thereof and comprising any one or any combination of the INHBE variant nucleic acid molecules described herein. Likewise, step b) can alternately comprise introducing a protein comprising a sequence that is at least 90%, at least 95%, at least 96%, at least 97%, at least 98%, at least 99%, or 100% identical to any INHBE protein isoform described herein or a fragment thereof and comprising any one or any combination of loss-of-function variant polypeptides described herein.

In some embodiments, a second nuclease agent is also introduced into the subject or into the liver cell in the subject, wherein the second nuclease agent binds to a second nuclease recognition sequence within the INHBE gene, wherein the second nuclease recognition sequence comprises the stop codon for the INHBE gene or is within about 10, 20, 30, 40, 50, 100, 200, 300, 400, 500, or 1,000 nucleotides of the stop codon, wherein the nuclease agent cleaves the INHBE gene in the liver cell within both the first nuclease recognition sequence and the second nuclease recognition sequence, wherein the liver cell is modified to comprise a deletion between the first nuclease recognition sequence and the second nuclease recognition sequence. For example, the second nuclease agent can be a Cas9 protein and a guide RNA. Suitable guide RNAs and guide RNA recognition sequences in proximity to the stop codon are disclosed elsewhere herein.

Such methods can also comprise a method of treating a subject who is not a carrier of any of the INHBE variant nucleic acid molecules described herein (or is only a heterozygous carrier of any one or any combination of the INHBE variant nucleic acid molecules described herein) and has or is susceptible to developing a metabolic disorder and/or a cardiovascular disease, comprising introducing into the subject or introducing into a liver cell in the subject: a) a DNA-binding protein (or nucleic acid encoding) that binds to a DNA-binding protein recognition sequence within an INHBE gene, wherein the DNA-binding protein recognition sequence comprises the start codon for the INHBE gene or is within about 10, 20, 30, 40, 50, 100, 200, 300, 400, 500, or 1,000 nucleotides of the start codon. The DNA-binding protein can alter (e.g., reduce) expression of the INHBE gene in a liver cell in the subject. Such methods can also comprise a method of treating a subject who is not a carrier of any of the INHBE variant nucleic acid molecules described herein (or is only a heterozygous carrier of any one or any combination of the INHBE variant nucleic acid molecules described herein) and has or is susceptible to developing a metabolic disorder and/or a cardiovascular disease, comprising introducing into the subject or introducing into a liver cell in the subject: a) a DNA-binding protein (or nucleic acid encoding) that binds to a DNA-binding protein recognition sequence within an INHBE gene, wherein the DNA-binding protein recognition sequence comprises the start codon for the INHBE gene or is within about 10, 20, 30, 40, 50, 100, 200, 300, 400, 500, or 1,000 nucleotides of the start codon; and b) an expression vector comprising a recombinant INHBE gene comprising any one or any combination of loss-of-function variants described herein. The expression vector can be one that does not genomically integrate. Alternately, a targeting vector (i.e., exogenous donor sequence) can be introduced comprising a recombinant INHBE gene comprising any one or any combination of the INHBE variant nucleic acid molecules described herein. The DNA-binding protein can alter (e.g., reduce) expression of the INHBE gene in a liver cell in the subject, and the expression vector can express the recombinant INHBE gene in the liver cell in the subject. Alternately, the genomically integrated, recombinant INHBE gene can express in the liver cell in the subject. Examples of DNA-binding proteins suitable for use in such methods are disclosed elsewhere herein. Such DNA-binding proteins (e.g., Cas9 protein and guide RNA) can be fused or operably linked to a transcriptional repressor domain. For example, the DNA-binding protein can be a catalytically inactive Cas9 protein fused to a transcriptional repressor domain. Examples of suitable guide RNAs and guide RNA recognition sequences are disclosed elsewhere herein. Step b) can alternately comprise introducing an expression vector or targeting vector comprising a nucleic acid (e.g., DNA) encoding an INHBE protein that is at least 90%, at least 95%, at least 96%, at least 97%, at least 98%, at least 99%, or 100% identical to any INHBE isoform described herein or a fragment thereof and comprising any one or any combination of the INHBE variant nucleic acid molecules described herein. Likewise, step b) can alternately comprise introducing an mRNA encoding an INHBE protein that is at least 90%, at least 95%, at least 96%, at least 97%, at least 98%, at least 99%, or 100% identical any INHBE mRNA isoform described herein or a fragment thereof and comprising any one or any combination of the INHBE variant nucleic acid molecules described herein. Likewise, step b) can alternately comprise introducing a protein comprising a sequence that is at least 90%, at least 95%, at least 96%, at least 97%, at least 98%, at least 99%, or 100% identical to any INHBE protein isoform described herein or a fragment thereof and comprising any one or any combination of loss-of-function variant polypeptides described herein.

Other such methods can comprise method of treating a subject who is not a carrier of any of the INHBE variant nucleic acid molecules described herein (or is only a heterozygous carrier of any one or any combination of the INHBE variant nucleic acid molecules described herein) and has or is susceptible to developing a metabolic disorder and/or a cardiovascular disease, comprising introducing into the subject or introducing into a liver cell in the subject an expression vector, wherein the expression vector comprises a recombinant INHBE gene comprising any one or any combination of loss-of-function variants described herein, wherein the expression vector expresses the recombinant INHBE gene in a liver cell in the subject. The expression vector can be one that does not genomically integrate. Alternately, a targeting vector (i.e., exogenous donor sequence) can be introduced comprising a recombinant INHBE gene comprising any one or any combination of the INHBE variant nucleic acid molecules described herein. In methods in which an expression vector is used, the expression vector can express the recombinant INHBE gene in the liver cell in the subject. Alternately, in methods in which a recombinant INHBE gene is genomically integrated, the recombinant INHBE gene can express in the liver cell in the subject. Such methods can alternately comprise introducing an expression vector or targeting vector comprising a nucleic acid (e.g., DNA) encoding an INHBE protein that is at least 90%, at least 95%, at least 96%, at least 97%, at least 98%, at least 99%, or 100% identical to any INHBE isoform described herein or a fragment thereof and comprising any one or any combination of loss-of-function variants described herein. Likewise, such methods can alternately comprise introducing an mRNA encoding an INHBE protein that is at least 90%, at least 95%, at least 96%, at least 97%, at least 98%, at least 99%, or 100% identical to any INHBE mRNA isoform described herein or a fragment thereof and comprising any one or any combination of the INHBE variant nucleic acid molecules described herein. Likewise, such methods can alternately comprise introducing a protein comprising a sequence that is at least 90%, at least 95%, at least 96%, at least 97%, at least 98%, at least 99%, or 100% identical to any INHBE protein isoform described herein or a fragment thereof and comprising any one or any combination of loss-of-function variant polypeptides described herein.

Suitable expression vectors and recombinant INHBE genes for use in any of the above methods are disclosed elsewhere herein. For example, the recombinant INHBE gene can be the full length variant gene or can be an INHBE minigene in which one or more nonessential segments of the gene have been deleted with respect to a corresponding wild type INHBE gene. As an example, the deleted segments can comprise one or more intronic sequences. An example of a full INHBE gene is one that is at least 90%, at least 95%, at least 96%, at least 97%, at least 98%, or at least 99% identical to SEQ ID NO:1 when optimally aligned with SEQ ID NO:1.

In some embodiments, the methods comprise modifying a cell (e.g., a liver cell) in a subject having or susceptible to developing a chronic liver disease. In some embodiments, the methods comprise modifying a cell (e.g., a cardiac cell) in a subject having or susceptible to developing a cardiovascular disease. In such methods, the nuclease agents and/or exogenous donor sequences and/or recombinant expression vectors can be introduced into the cell via administration in an effective regime meaning a dosage, route of administration and frequency of administration that delays the onset, reduces the severity, inhibits further deterioration, and/or ameliorates at least one sign or symptom of the disease being treated. The term "symptom" refers to a subjective evidence of a disease as perceived by the subject, and a "sign" refers to objective evidence of a disease as observed by a physician. If a subject is already suffering from a disease, the regime can be referred to as a therapeutically effective regime. If the subject is at elevated risk of the disease relative to the general population but is not yet experiencing symptoms, the regime can be referred to as a prophylactically effective regime. In some instances, therapeutic or prophylactic efficacy can be observed in an individual patient relative to historical controls or past experience in the same subject. In other instances, therapeutic or prophylactic efficacy can be demonstrated in a preclinical or clinical trial in a population of treated subjects relative to a control population of untreated subjects.

Delivery can be any suitable method, as disclosed elsewhere herein. For example, the nuclease agents or exogenous donor sequences or recombinant expression vectors can be delivered by vector delivery, viral delivery, particle-mediated delivery, nanoparticle-mediated delivery, liposome-mediated delivery, exosome-mediated delivery, lipid-mediated delivery, lipid-nanoparticle-mediated delivery, cell-penetrating-peptide-mediated delivery, or implantable-device-mediated delivery. Some specific examples include hydrodynamic delivery, virus-mediated delivery, and lipid-nanoparticle-mediated delivery. Administration can be by any suitable route including, for example, parenteral, intravenous, oral, subcutaneous, intra-arterial, intracranial, intrathecal, intraperitoneal, topical, intranasal, or intramuscular. A specific example which is often used, for example, for protein replacement therapies is intravenous infusion. The frequency of administration and the number of dosages can depend on the half-life of the nuclease agents or exogenous donor sequences or recombinant expression vectors, the condition of the subject, and the route of administration among other factors. Pharmaceutical compositions for administration are preferably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

Other such methods comprise an ex vivo method in a cell from a subject having or susceptible to developing a chronic liver disease and/or a cardiovascular disease. The cell with the targeted genetic modification can then be transplanted back into the subject.

In some embodiments, the INHBE inhibitor comprises a small molecule. In some embodiments, the INHBE inhibitor is any of the inhibitory nucleic acid molecules described herein. In some embodiments, the INHBE inhibitor comprises an antibody.

In some embodiments, the methods of treatment further comprise detecting the presence or absence of an INHBE variant nucleic acid molecule encoding an INHBE predicted loss-of-function polypeptide, or the presence of the corresponding INHBE polypeptide, or the quantification of the INHBE polypeptide or nucleic acid (such as RNA) in a biological sample from the subject. As used throughout the present disclosure, an "an INHBE variant nucleic acid molecule" is any INHBE nucleic acid molecule (such as, for example, genomic nucleic acid molecule, mRNA molecule, or cDNA molecule) encoding an INHBE polypeptide having a partial loss-of-function, a complete loss-of-function, a predicted partial loss-of-function, or a predicted complete loss-of-function.

The present disclosure also provides methods of treating a subject with a therapeutic agent that treats or inhibits a metabolic disorder, wherein the subject is suffering from the metabolic disorder. In some embodiments, the methods comprise determining whether the subject has an INHBE variant nucleic acid molecule encoding an INHBE predicted loss-of-function polypeptide by obtaining or having obtained a biological sample from the subject, and performing or having performed a genotyping assay on the biological sample to determine if the subject has a genotype comprising the INHBE variant nucleic acid molecule. When the subject is INHBE reference, the therapeutic agent that treats or inhibits the metabolic disorder is administered or continued to be administered to the subject in a standard dosage amount, and an INHBE inhibitor is administered to the subject. When the subject is heterozygous for an INHBE variant nucleic acid molecule, the therapeutic agent that treats or inhibits the metabolic disorder is administered or continued to be administered to the subject in an amount that is the same as or lower than a standard dosage amount, and an INHBE inhibitor is administered to the subject. When the subject is homozygous for an INHBE variant nucleic acid molecule, the therapeutic agent that treats or inhibits the metabolic disorder is administered or continued to be administered to the subject in an amount that is the same as or lower than a standard dosage amount. The presence of a genotype having an INHBE variant nucleic acid molecule encoding an INHBE predicted loss-of-function polypeptide indicates the subject has a decreased risk of developing a metabolic disorder. In some embodiments, the subject is INHBE reference. In some embodiments, the subject is heterozygous for an INHBE variant nucleic acid molecule encoding an INHBE predicted loss-of-function polypeptide.

For subjects that are genotyped or determined to be either INHBE reference or heterozygous for an INHBE variant nucleic acid molecule encoding an INHBE predicted loss-of-function polypeptide, such subjects can be treated with an INHBE inhibitor, as described herein.

The present disclosure also provides methods of treating a subject with a therapeutic agent that treats or inhibits a cardiovascular disease, wherein the subject is suffering from the cardiovascular disease. In some embodiments, the methods comprise determining whether the subject has an INHBE variant nucleic acid molecule encoding an INHBE predicted loss-of-function polypeptide by obtaining or having obtained a biological sample from the subject, and performing or having performed a genotyping assay on the biological sample to determine if the subject has a genotype comprising the INHBE variant nucleic acid molecule. When the subject is INHBE reference, the therapeutic agent that treats or inhibits the cardiovascular disease is administered or continued to be administered to the subject in a standard dosage amount, and an INHBE inhibitor is administered to the subject. When the subject is heterozygous for an INHBE variant nucleic acid molecule, the therapeutic agent that treats or inhibits the cardiovascular disease is administered or continued to be administered to the subject in an amount that is the same as or lower than a standard dosage amount, and an INHBE inhibitor is administered to the subject. When the subject is homozygous for an INHBE variant nucleic acid molecule, the therapeutic agent that treats or inhibits the cardiovascular disease is administered or continued to be administered to the subject in an amount that is the same as or lower than a standard dosage amount. The presence of a genotype having an INHBE variant nucleic acid molecule encoding an INHBE predicted loss-of-function polypeptide indicates the subject has a decreased risk of developing a cardiovascular disease. In some embodiments, the subject is INHBE reference. In some embodiments, the subject is heterozygous for an INHBE variant nucleic acid molecule encoding an INHBE predicted loss-of-function polypeptide.

For subjects that are genotyped or determined to be either INHBE reference or heterozygous for an INHBE variant nucleic acid molecule encoding an INHBE predicted loss-of-function polypeptide, such subjects can be treated with an INHBE inhibitor, as described herein.

Detecting the presence or absence of an INHBE variant nucleic acid molecule encoding an INHBE predicted loss-of-function polypeptide in a biological sample from a subject and/or determining whether a subject has an INHBE variant nucleic acid molecule encoding an INHBE predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when the subject is INHBE reference, the subject is also administered a therapeutic agent that treats or inhibits a metabolic disorder in a standard dosage amount. In some embodiments, when the subject is heterozygous or homozygous for an INHBE variant nucleic acid molecule encoding an INHBE predicted loss-of-function polypeptide, the subject is also administered a therapeutic agent that treats or inhibits the metabolic disorder in a dosage amount that is the same as or lower than a standard dosage amount.

In some embodiments, when the subject is INHBE reference, the subject is also administered a therapeutic agent that treats or inhibits a cardiovascular disease in a standard dosage amount. In some embodiments, when the subject is heterozygous or homozygous for an INHBE variant nucleic acid molecule encoding an INHBE predicted loss-of-function polypeptide, the subject is also administered a therapeutic agent that treats or inhibits the cardiovascular disease in a dosage amount that is the same as or lower than a standard dosage amount.

In some embodiments, the treatment methods further comprise detecting the presence or absence of an INHBE predicted loss-of-function polypeptide in a biological sample from the subject. In some embodiments, when the subject does not have an INHBE predicted loss-of-function polypeptide, the subject is also administered a therapeutic agent that treats or inhibits a metabolic disorder in a standard dosage amount. In some embodiments, when the subject has an INHBE predicted loss-of-function polypeptide, the subject is also administered a therapeutic agent that treats or inhibits the metabolic disorder in a dosage amount that is the same as or lower than a standard dosage amount.

In some embodiments, the treatment methods further comprise detecting the presence or absence of an INHBE predicted loss-of-function polypeptide in a biological sample from the subject. In some embodiments, when the subject does not have an INHBE predicted loss-of-function polypeptide, the subject is also administered a therapeutic agent that treats or inhibits a cardiovascular disease in a standard dosage amount. In some embodiments, when the subject has an INHBE predicted loss-of-function polypeptide, the subject is also administered a therapeutic agent that treats or inhibits the cardiovascular disease in a dosage amount that is the same as or lower than a standard dosage amount.

The present disclosure also provides methods of treating a subject with a therapeutic agent that treats or inhibits a metabolic disorder, wherein the subject is suffering from the metabolic disorder. In some embodiments, the method comprises determining whether the subject has an INHBE predicted loss-of-function polypeptide by obtaining or having obtained a biological sample from the subject, and performing or having performed an assay on the biological sample to determine if the subject has an INHBE predicted loss-of-function polypeptide. When the subject does not have an INHBE predicted loss-of-function polypeptide, the therapeutic agent that treats or inhibits the metabolic disorder is administered or continued to be administered to the subject in a standard dosage amount, and an INHBE inhibitor is administered to the subject. When the subject has an INHBE predicted loss-of-function polypeptide, the therapeutic agent that treats or inhibits the metabolic disorder is administered or continued to be administered to the subject in an amount that is the same as or lower than a standard dosage amount, and an INHBE inhibitor is administered to the subject. The presence of an INHBE predicted loss-of-function polypeptide indicates the subject has a decreased risk of developing a metabolic disorder. In some embodiments, the subject has an INHBE predicted loss-of-function polypeptide. In some embodiments, the subject does not have an INHBE predicted loss-of-function polypeptide.

The present disclosure also provides methods of treating a subject with a therapeutic agent that treats or inhibits a cardiovascular disease, wherein the subject is suffering from the cardiovascular disease. In some embodiments, the method comprises determining whether the subject has an INHBE predicted loss-of-function polypeptide by obtaining or having obtained a biological sample from the subject, and performing or having performed an assay on the biological sample to determine if the subject has an INHBE predicted loss-of-function polypeptide. When the subject does not have an INHBE predicted loss-of-function polypeptide, the therapeutic agent that treats or inhibits the cardiovascular disease is administered or continued to be administered to the subject in a standard dosage amount, and an INHBE inhibitor is administered to the subject. When the subject has an INHBE predicted loss-of-function polypeptide, the therapeutic agent that treats or inhibits the cardiovascular disease is administered or continued to be administered to the subject in an amount that is the same as or lower than a standard dosage amount, and an INHBE inhibitor is administered to the subject. The presence of an INHBE predicted loss-of-function polypeptide indicates the subject has a decreased risk of developing a cardiovascular disease. In some embodiments, the subject has an INHBE predicted loss-of-function polypeptide. In some embodiments, the subject does not have an INHBE predicted loss-of-function polypeptide.

Detecting the presence or absence of an INHBE predicted loss-of-function polypeptide in a biological sample from a subject and/or determining whether a subject has an INHBE predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the polypeptide can be present within a cell or blood sample obtained from the subject, or maybe imputed from other information about the subject that has previously been generated from collection of a cell or blood sample from the subject or biological relatives of the subject. In any of these embodiments, determination by quantification of the amount of INHBE polypeptide can be included as a determination of loss of function due to the effective absence or reduction in the amount of the INHBE polypeptide. In any of these embodiments, detection, sequencing, and/or quantification of INHBE DNA and RNA can serve as methods for determining INHBE loss of function or absence of INHBE entirely.

Examples of therapeutic agents that treat or inhibit type 2 diabetes include, but are not limited to: metformin, insulin, sulfonylureas (such as glyburide, glipizide, and glimepiride), meglitinides (such as repaglinide and nateglinide), thiazolidinediones (such as rosiglitazone and pioglitazone), DPP-4 inhibitors (such as sitagliptin, saxagliptin, and linagliptin), GLP-1 receptor agonists (such as exenatide, liraglutide, and semaglutide), and SGLT2 inhibitors (such as canagliflozin, dapagliflozin, and empagliflozin). In some embodiments, the therapeutic agent is metformin, insulin, glyburide, glipizide, glimepiride, repaglinide, nateglinide, rosiglitazone, pioglitazone, sitagliptin, saxagliptin, linagliptin, exenatide, liraglutide, semaglutide, canagliflozin, dapagliflozin, or empagliflozin. In some embodiments, the therapeutic agent is metformin. In some embodiments, the therapeutic agent is insulin. In some embodiments, the therapeutic agent is glyburide. In some embodiments, the therapeutic agent is glipizide. In some embodiments, the therapeutic agent is glimepiride. In some embodiments, the therapeutic agent is repaglinide. In some embodiments, the therapeutic agent is nateglinide. In some embodiments, the therapeutic agent is rosiglitazone. In some embodiments, the therapeutic agent is pioglitazone. In some embodiments, the therapeutic agent is sitagliptin. In some embodiments, the therapeutic agent is saxagliptin. In some embodiments, the therapeutic agent is linagliptin. In some embodiments, the therapeutic agent is exenatide. In some embodiments, the therapeutic agent is liraglutide. In some embodiments, the therapeutic agent is semaglutide. In some embodiments, the therapeutic agent is canagliflozin. In some embodiments, the therapeutic agent is dapagliflozin. In some embodiments, the therapeutic agent is empagliflozin.

Examples of therapeutic agents that treat or inhibit obesity include, but are not limited to: orlistat, phentermine, topiramate, bupropion, naltrexone, and liraglutide. In some embodiments, the therapeutic agent is orlistat. In some embodiments, the therapeutic agent is phentermine. In some embodiments, the therapeutic agent is topiramate. In some embodiments, the therapeutic agent is bupropion. In some embodiments, the therapeutic agent is naltrexone. In some embodiments, the therapeutic agent is liraglutide.

Examples of therapeutic agents that treat or inhibit elevated triglyceride include, but are not limited to: statins (such as rosuvastatin, simvastatin, and atorvastatin), fibrates (such as fenofibrate, gemfibrozil, and fenofibric acid), nicotinic acid (such as niacin), and fatty acids (such as omega-3 fatty acids). In some embodiments, the therapeutic agent is a statin.

Examples of therapeutic agents that treat or inhibit lipodystrophy include, but are not limited to: EGRIFTA® (tesamorelin), GLUCOPHAGE® (metformin), SCULPTRA® (poly-L-lactic acid), RADIESSE® (calcium hydroxyapatite), polymethylmethacrylate (e.g., PMMA), ZYDERM® (bovine collagen), COSMODERM® (human collagen), silicone, glitazones, and hyaluronic acid. In some embodiments, the therapeutic agent that treats or inhibits lipodystrophy include, but are not limited to: tesamorelin, metformin, poly-L-lactic acid, a calcium hydroxyapatite, polymethylmethacrylate, a bovine collagen, a human collagen, silicone, and hyaluronic acid.

Examples of therapeutic agents that treat or inhibit liver inflammation include, but are not limited to hepatitis therapeutics and hepatitis vaccines.

Examples of therapeutic agents or procedures that treat or inhibit fatty liver disease include, but are not limited to, bariatric surgery and/or dietary intervention.

Examples of therapeutic agents that treat or inhibit hypercholesterolemia include, but are not limited to: statins (e.g., LIPITOR® (atorvastatin), LESCOL® (fluvastatin), lovastatin, LIVALO® (pitavastatin), PRAVACHOL® (pravastatin), CRESTOR® (rosuvastatin calcium), and ZOCOR® (simvastatin)); bile acid sequestrants (e.g., PREVALITE® (cholestyramine), WELCHOL® (colesevelam), and COLESTID® (colestipol)); PCSK9 Inhibitors (e.g., PRALUENT® (alirocumab) and REPATHA® (evolocumab); niacin (e.g., niaspan and niacor); fibrates (e.g., fenofibrate and LOPID® (gemfibrozil)); and ATP Citrate Lyase (ACL) Inhibitors (e.g., NEXLETOL® (bempedoic)). In some embodiments, the therapeutic agent that treats or inhibits hypercholesterolemia include, but are not limited to: statins (e.g., atorvastatin, fluvastatin, lovastatin, pitavastatin, pravastatin, rosuvastatin calcium, and simvastatin); bile acid sequestrants (e.g., cholestyramine, colesevelam, and colestipol); PCSK9 Inhibitors (e.g., alirocumab and evolocumab; niacin (e.g., niaspan and niacor); fibrates (e.g., fenofibrate and gemfibrozil); and ACL Inhibitors (e.g., bempedoic). In some embodiments, the therapeutic agent that treats or inhibits hypercholesterolemia is alirocumab or evolocumab. In some embodiments, the therapeutic agent that treats or inhibits hypercholesterolemia is alirocumab. In some embodiments, the therapeutic agent that treats or inhibits hypercholesterolemia is evolocumab.

Examples of therapeutic agents that treat or inhibit elevated liver enzymes (such as, for example, ALT and/or AST) include, but are not limited to, coffee, folic acid, potassium, vitamin B6, a statin, and fiber, or any combination thereof.

Examples of therapeutic agents that treat or inhibit NASH include, but are not limited to, OCALIVA® (obeticholic acid), Pioglitazone or other glitazones, Selonsertib, Elafibranor, Cenicriviroc, GR_MD_02, MGL_3196, IMM124E, arachidyl amido cholanoic acid (ARAMCHOL™), GS0976, Emricasan, Volixibat, NGM282, GS9674, Tropifexor, MN_001, LMB763, BI_1467335, MSDC_0602, PF_05221304, DF102, Saroglitazar, BMS986036, Lanifibranor, Semaglutide, Nitazoxanide, GRI_0621, EYP001, VK2809, Nalmefene, LIK066, MT_3995, Elobixibat, Namodenoson, Foralumab, SAR425899, Sotagliflozin, EDP_305, Isosabutate, Gemcabene, TERN_101, KBP_042, PF_06865571, DUR928, PF_06835919, NGM313, BMS_986171, Namacizumab, CER_209, ND_L02_s0201, RTU_1096, DRX_065, IONIS_DGAT2Rx, INT_767, NC_001, Seladepar, PXL770, TERN_201, NV556, AZD2693, SP_1373, VK0214, Hepastem, TGFTX4, RLBN1127, GKT_137831, RYI_018, CB4209-CB4211, and JH_0920.

In some embodiments, the therapeutic agent that treats or metabolic disorders is a melanocortin 4 receptor (MC4R) agonist. In some embodiments, the MC4R agonist comprises a protein, a peptide, a nucleic acid molecule, or a small molecule. In some embodiments, the protein is a peptide analog of MC4R. In some embodiments, the peptide is setmelanotide. In some embodiments, the therapeutic agent that treats or inhibits type 2 diabetes and/or reduces BMI is a combination of setmelanotide and one or more of sibutramine, orlistat, phentermine, lorcaserin, naltrexone, liraglutide, diethylpropion, bupropion, metformin, pramlintide, topiramate, and zonisamide. In some embodiments, the MC4R agonist is a peptide comprising the amino acid sequence His-Phe-Arg-Trp. In some embodiments, the small molecule is 1,2,3R,4-tetrahydroisoquinoline-3-carboxylic acid. In some embodiments, the MC4R agonist is ALB-127158(a).

Examples of therapeutic agents that treat or inhibit cardiomyopathy include, but are not limited to: 1) blood pressure lowering agents, such as ACE inhibitors, angiotensin II receptor blockers, beta blockers, and calcium channel blockers; 2) agents that slow heart rate, such as beta blockers, calcium channel blockers, and digoxin; 3) agents that keep the heart beating with a normal rhythm, such as antiarrhythmics; 4) agents that balance electrolytes, such as aldosterone blockers; 5) agents that remove excess fluid and sodium from the body, such as diuretics; 6) agents that prevent blood clots from forming, such as anticoagulants or blood thinners; and 7) agents that reduce inflammation, such as corticosteroids.

Examples of therapeutic agents that treat or inhibit heart failure include, but are not limited to: ACE inhibitors, angiotensin-2 receptor blockers, beta blockers, mineralocorticoid receptor antagonists, diuretics, ivabradine, sacubitril valsartan, hydralazine with nitrate, and digoxin.

Examples of therapeutic agents that treat or inhibit high blood pressure include, but are not limited to: diuretics (such as, chlorthalidone, chlorothiazide, hydrochlorothiazide, indapamide, and metolazone), beta-blockers (such as acebutolol, atenolol, betaxolol, bisoprolol fumarate, carteolol hydrochloride, metoprolol tartrate, metoprolol succinate, nadolol, etc.), ACE inhibitors (such as benazepril hydrochloride, captopril, enalapril maleate, fosinopril sodium, lisinopril, moexipril, perindopril, quinapril hydrochloride, ramipril, and trandolapril), angiotensin II receptor blockers (such as candesartan, eprosartan mesylate, irbesartan, losartan potassium, telmisartan, and valsartan), calcium channel blockers (such as amlodipine besylate, bepridil, diltiazem hydrochloride, felodipine, isradipine, nicardipine, nifedipine, nisoldipine, and verapamil hydrochloride), alpha blockers (such as doxazocin mesylate, prazosin hydrochloride, and terazosin hydrochloride), Alpha-2 Receptor Agonists (such as methyldopa), combined alpha and beta-blockers (such as carvedilol and labetalol hydrochloride), central agonists (such as alpha methyldopa, clonidine hydrochloride, guanabenz acetate, and guanfacine hydrochloride), peripheral adrenergic inhibitors (such as guanadrel, guanethidine monosulfate, and reserpine), and vasodilators (such as hydralazine hydrochloride and minoxidil).

In some embodiments, the dose of the therapeutic agents that treat or inhibit metabolic disorders and/or cardiovascular diseases can be reduced by about 10%, by about 20%, by about 30%, by about 40%, by about 50%, by about 60%, by about 70%, by about 80%, or by about 90% for subjects that are heterozygous for an INHBE predicted loss-of-function variant (i.e., a lower than the standard dosage amount) compared to subjects that are INHBE reference (who may receive a standard dosage amount). In some embodiments, the dose of the therapeutic agents that treat or inhibit metabolic disorders and/or cardiovascular diseases can be reduced by about 10%, by about 20%, by about 30%, by about 40%, or by about 50%. In addition, the subjects that are heterozygous for an INHBE predicted loss-of-function variant can be administered less frequently compared to subjects that are INHBE reference.

In some embodiments, the dose of the therapeutic agents that treat or a metabolic disorder and/or a cardiovascular disease can be reduced by about 10%, by about 20%, by about 30%, by about 40%, by about 50%, for subjects that are homozygous for a predicted loss-of-function variant INHBE nucleic acid molecule compared to subjects that are heterozygous for a predicted loss-of-function variant INHBE nucleic acid molecule. In some embodiments, the dose of the therapeutic agents that treat or inhibit a metabolic disorder and/or a cardiovascular disease can be reduced by about 10%, by about 20%, by about 30%, by about 40%, or by about 50%. In addition, the dose of therapeutic agents that treat or inhibit metabolic disorder and/or a cardiovascular disease in subjects that are homozygous for a predicted loss-of-function variant INHBE nucleic acid molecule can be administered less frequently compared to subjects that are heterozygous for a predicted loss-of-function variant INHBE nucleic acid molecule.

Administration of the therapeutic agents that treat or inhibit metabolic disorders and/or cardiovascular diseases and/or INHBE inhibitors can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more.

Administration of the therapeutic agents that treat or inhibit metabolic disorders and/or cardiovascular diseases and/or INHBE inhibitors can occur by any suitable route including, but not limited to, parenteral, intravenous, oral, subcutaneous, intra-arterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in metabolic disorders and/or cardiovascular diseases, a decrease/reduction in the severity of metabolic disorders and/or cardiovascular diseases (such as, for example, a reduction or inhibition of development or metabolic disorders and/or cardiovascular diseases), a decrease/reduction in symptoms and metabolic disorder-related effects and/or cardiovascular disease-related effects, delaying the onset of symptoms and metabolic disorder-related effects and/or cardiovascular disease-related effects, reducing the severity of symptoms of metabolic disorder-related effects and/or cardiovascular disease-related effects, reducing the number of symptoms and metabolic disorder-related effects and/or cardiovascular disease-related effects, reducing the latency of symptoms and metabolic disorder-related effects and/or cardiovascular disease-related effects, an amelioration of symptoms and metabolic disorder-related effects and/or cardiovascular disease-related effects, reducing secondary symptoms, reducing secondary infections, preventing relapse to metabolic disorders and/or cardiovascular diseases, decreasing the number or frequency of relapse episodes, increasing latency between symptomatic episodes, increasing time to sustained progression, speeding recovery, or increasing efficacy of or decreasing resistance to alternative therapeutics, and/or an increased survival time of the affected host animal, following administration of the agent or composition comprising the agent. A prophylactic effect may comprise a complete or partial avoidance/inhibition or a delay of metabolic disorders and/or cardiovascular disease development/progression (such as, for example, a complete or partial avoidance/inhibition or a delay), and an increased survival time of the affected host animal, following administration of a therapeutic protocol. Treatment of metabolic disorders encompasses the treatment of subjects already diagnosed as having any form of metabolic disorders and/or cardiovascular diseases at any clinical stage or manifestation, the delay of the onset or evolution or aggravation or deterioration of the symptoms or signs of metabolic disorders and/or cardiovascular diseases, and/or preventing and/or reducing the severity of metabolic disorders and/or cardiovascular diseases.

The present disclosure also provides methods of identifying a subject having an increased risk for developing a metabolic disorder. In some embodiments, the method comprises determining or having determined in a biological sample obtained from the subject the presence or absence of an INHBE variant nucleic acid molecule (such as a genomic nucleic acid molecule, mRNA molecule, and/or cDNA molecule) encoding an INHBE predicted loss-of-function polypeptide. When the subject lacks an INHBE variant nucleic acid molecule encoding an INHBE predicted loss-of-function polypeptide (i.e., the subject is genotypically categorized as an INHBE reference), then the subject has an increased risk for developing a metabolic disorder. When the subject has an INHBE variant nucleic acid molecule encoding an INHBE predicted loss-of-function polypeptide (i.e., the subject is heterozygous or homozygous for an INHBE variant nucleic acid molecule encoding an INHBE predicted loss-of-function polypeptide), then the subject has a decreased risk for developing a metabolic disorder. In some embodiments, liver expression quantitative trait loci (eQTL) can be analyzed.

The present disclosure also provides methods of identifying a subject having an increased risk for developing a cardiovascular disease. In some embodiments, the method comprises determining or having determined in a biological sample obtained from the subject the presence or absence of an INHBE variant nucleic acid molecule (such as a genomic nucleic acid molecule, mRNA molecule, and/or cDNA molecule) encoding an INHBE predicted loss-of-function polypeptide. When the subject lacks an INHBE variant nucleic acid molecule encoding an INHBE predicted loss-of-function polypeptide (i.e., the subject is genotypically categorized as an INHBE reference), then the subject has an increased risk for developing a cardiovascular disease. When the subject has an INHBE variant nucleic acid molecule encoding an INHBE predicted loss-of-function polypeptide (i.e., the subject is heterozygous or homozygous for an INHBE variant nucleic acid molecule encoding an INHBE predicted loss-of-function polypeptide), then the subject has a decreased risk for developing a cardiovascular disease. In some embodiments, liver expression quantitative trait loci (eQTL) can be analyzed.

Having a single copy of an INHBE variant nucleic acid molecule encoding an INHBE predicted loss-of-function polypeptide is more protective of a subject from developing a metabolic disorder and/or a cardiovascular disease than having no copies of an INHBE variant nucleic acid molecule encoding an INHBE predicted loss-of-function polypeptide. Without intending to be limited to any particular theory or mechanism of action, it is believed that a single copy of an INHBE variant nucleic acid molecule (i.e., heterozygous for an INHBE variant nucleic acid molecule) is protective of a subject from developing a metabolic disorder and/or a cardiovascular disease, and it is also believed that having two copies of an INHBE variant nucleic acid molecule (i.e., homozygous for an INHBE variant nucleic acid molecule) may be more protective of a subject from developing a metabolic disorder and/or a cardiovascular disease, relative to a subject with a single copy. Thus, in some embodiments, a single copy of an INHBE variant nucleic acid molecule may not be completely protective, but instead, may be partially or incompletely protective of a subject from developing a metabolic disorder and/or a cardiovascular disease. While not desiring to be bound by any particular theory, there may be additional factors or molecules involved in the development of metabolic disorders and/or cardiovascular diseases that are still present in a subject having a single copy of an INHBE variant nucleic acid molecule, thus resulting in less than complete protection from the development of metabolic disorders and/or cardiovascular diseases.

Determining whether a subject has an INHBE variant nucleic acid molecule encoding an INHBE predicted loss-of-function polypeptide in a biological sample from a subject and/or determining whether a subject has an INHBE variant nucleic acid molecule encoding an INHBE predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when a subject is identified as having an increased risk of developing a metabolic disorder, the subject is further treated with a therapeutic agent that treats or inhibits metabolic disorders and/or an INHBE inhibitor, as described herein. For example, when the subject is INHBE reference, and therefore has an increased risk for developing a metabolic disorder, the subject is administered an INHBE inhibitor. In some embodiments, such a subject is also administered a therapeutic agent that treats or inhibits metabolic disorders. In some embodiments, when the subject is heterozygous for an INHBE variant nucleic acid molecule encoding an INHBE predicted loss-of-function polypeptide, the subject is administered the therapeutic agent that treats or inhibits metabolic disorders in a dosage amount that is the same as or lower than a standard dosage amount, and is also administered an INHBE inhibitor. In some embodiments, such a subject is also administered a therapeutic agent that treats or inhibits metabolic disorders. In some embodiments, when the subject is homozygous for an INHBE variant nucleic acid molecule encoding an INHBE predicted loss-of-function polypeptide, the subject is administered the therapeutic agent that treats or inhibits metabolic disorders in a dosage amount that is the same as or lower than a standard dosage amount. In some embodiments, the subject is INHBE reference. In some embodiments, the subject is heterozygous for an INHBE variant nucleic acid molecule encoding an INHBE predicted loss-of-function polypeptide. In some embodiments, the subject is homozygous for an INHBE variant nucleic acid molecule encoding an INHBE predicted loss-of-function polypeptide.

In some embodiments, when a subject is identified as having an increased risk of developing a cardiovascular disease, the subject is further treated with a therapeutic agent that treats or inhibits cardiovascular diseases and/or an INHBE inhibitor, as described herein. For example, when the subject is INHBE reference, and therefore has an increased risk for developing a cardiovascular disease, the subject is administered an INHBE inhibitor. In some embodiments, such a subject is also administered a therapeutic agent that treats or inhibits cardiovascular diseases. In some embodiments, when the subject is heterozygous for an INHBE variant nucleic acid molecule encoding an INHBE predicted loss-of-function polypeptide, the subject is administered the therapeutic agent that treats or inhibits cardiovascular diseases in a dosage amount that is the same as or lower than a standard dosage amount, and is also administered an INHBE inhibitor. In some embodiments, such a subject is also administered a therapeutic agent that treats or inhibits cardiovascular diseases. In some embodiments, when the subject is homozygous for an INHBE variant nucleic acid molecule encoding an INHBE predicted loss-of-function polypeptide, the subject is administered the therapeutic agent that treats or inhibits cardiovascular diseases in a dosage amount that is the same as or lower than a standard dosage amount. In some embodiments, the subject is INHBE reference. In some embodiments, the subject is heterozygous for an INHBE variant nucleic acid molecule encoding an INHBE predicted loss-of-function polypeptide. In some embodiments, the subject is homozygous for an INHBE variant nucleic acid molecule encoding an INHBE predicted loss-of-function polypeptide.

In some embodiments, any of the methods described herein can further comprise determining the subject's gene burden of having an INHBE variant nucleic acid molecule encoding an INHBE predicted loss-of-function polypeptide, and/or an INHBE predicted loss-of-function variant polypeptide associated with a decreased risk of developing a metabolic disorder and/or a cardiovascular disease. The gene burden is the aggregate of all variants in the INHBE gene, which can be carried out in an association analysis with metabolic disorders and/or cardiovascular diseases. In some embodiments, the subject is homozygous for one or more INHBE variant nucleic acid molecules encoding an INHBE predicted loss-of-function polypeptide associated with a decreased risk of developing a metabolic disorder and/or a cardiovascular disease. In some embodiments, the subject is heterozygous for one or more INHBE variant nucleic acid molecules encoding an INHBE predicted loss-of-function polypeptide associated with a decreased risk of developing a metabolic disorder and/or a cardiovascular disease. The result of the association analysis suggests that INHBE variant nucleic acid molecules encoding an INHBE predicted loss-of-function polypeptide are associated with decreased risk of developing a metabolic disorder and/or a cardiovascular disease. When the subject has a lower gene burden, the subject is at a higher risk of developing a metabolic disorder and/or a cardiovascular disease and the subject is administered or continued to be administered the therapeutic agent that treats, prevents, or inhibits a metabolic disorder and/or a cardiovascular disease in a standard dosage amount, and/or an INHBE inhibitor. When the subject has a greater gene burden, the subject is at a lower risk of developing a metabolic disorder and/or a cardiovascular disease and the subject is administered or continued to be administered the therapeutic agent that treats, prevents, or inhibits a metabolic disorder and/or a cardiovascular disease in an amount that is the same as or less than the standard dosage amount. The greater the gene burden, the lower the risk of developing a metabolic disorder and/or a cardiovascular disease.

In some embodiments, the subject's gene burden of having any one or more INHBE variant nucleic acid molecules encoding an INHBE predicted loss-of-function polypeptide represents a weighted sum of a plurality of any of the INHBE variant nucleic acid molecules encoding an INHBE predicted loss-of-function polypeptide. In some embodiments, the gene burden is calculated using at least about 2, at least about 3, at least about 4, at least about 5, at least about 10, at least about 20, at least about 30, at least about 40, at least about 50, at least about 60, at least about 70, at least about 80, at least about 100, at least about 120, at least about 150, at least about 200, at least about 250, at least about 300, at least about 400, at least about 500, at least about 1,000, at least about 10,000, at least about 100,000, or at least about or more than 1,000,000 genetic variants present in or around (up to 10 Mb) the INHBE gene where the gene burden is the number of alleles multiplied by the association estimate with a metabolic disorder or related outcome for each allele (e.g., a weighted burden score). This can include any genetic variants, regardless of their genomic annotation, in proximity to the INHBE gene (up to 10 Mb around the gene) that show a non-zero association with a metabolic disorder-related traits and/or a cardiovascular disease-related traits in a genetic association analysis. In some embodiments, when the subject has a gene burden above a desired threshold score, the subject has a decreased risk of developing a metabolic disorder and/or a cardiovascular disease. In some embodiments, when the subject has a gene burden below a desired threshold score, the subject has an increased risk of developing a metabolic disorder and/or a cardiovascular disease.

In some embodiments, the gene burden may be divided into quintiles, e.g., top quintile, intermediate quintile, and bottom quintile, wherein the top quintile of the gene burden corresponds to the lowest risk group and the bottom quintile of the gene burden corresponds to the highest risk group. In some embodiments, a subject having a greater gene burden comprises the highest weighted gene burdens, including, but not limited to the top 10%, top 20%, top 30%, top 40%, or top 50% of gene burdens from a subject population. In some embodiments, the genetic variants comprise the genetic variants having association with a metabolic disorder and/or a cardiovascular disease in the top 10%, top 20%, top 30%, top 40%, or top 50% of p-value range for the association. In some embodiments, each of the identified genetic variants comprise the genetic variants having association with a metabolic disorder and/or a cardiovascular disease with p-value of no more than about $10^{-2}$, about $10^{-3}$, about $10^{-4}$, about $10^{-5}$, about $10^{-6}$, about $10^{-7}$, about $10^{-8}$, about $10^{-9}$, about $10^{-10}$, about $10^{-11}$, about $10^{-12}$, about $10^{-13}$, about $10^{-14}$, about or $10^{-15}$. In some embodiments, the identified genetic variants comprise the genetic variants having association with a metabolic disorder and/or a cardiovascular disease with p-value of less than $5 \times 10^{-8}$. In some embodiments, the identified genetic variants comprise genetic variants having association with a metabolic disorder and/or a cardiovascular disease in high-risk subjects as compared to the rest of the reference population with odds ratio (OR) about 1.5 or greater, about 1.75 or greater, about 2.0 or greater, or about 2.25 or greater for the top 20% of the distribution; or about 1.5 or greater, about 1.75 or greater, about 2.0 or greater, about 2.25 or greater, about 2.5 or greater, or about 2.75 or greater. In some embodiments, the odds ratio (OR) may range from about 1.0 to about 1.5, from about 1.5 to about 2.0, from about 2.0 to about 2.5, from about 2.5 to about 3.0, from about 3.0 to about 3.5, from about 3.5 to about 4.0, from about 4.0 to about 4.5, from about 4.5 to about 5.0, from about 5.0 to about 5.5, from about 5.5 to about 6.0, from about 6.0 to about 6.5, from about 6.5 to about 7.0, or greater than 7.0. In some embodiments, high-risk subjects comprise subjects having gene burdens in the bottom decile, quintile, or tertile in a reference population. The threshold of the gene burden is determined on the basis of the nature of the intended practical application and the risk difference that would be considered meaningful for that practical application.

In some embodiments, when a subject is identified as having an increased risk of developing a metabolic disorder, the subject is further administered a therapeutic agent that treats, prevents, or inhibits a metabolic disorder, and/or an INHBE inhibitor, as described herein. For example, when the subject is INHBE reference, and therefore has an increased risk of developing a metabolic disorder, the subject is administered an INHBE inhibitor. In some embodiments, such a subject is also administered a therapeutic agent that treats, prevents, or inhibits a metabolic disorder. In some embodiments, when the subject is heterozygous for an INHBE variant nucleic acid molecule encoding an INHBE predicted loss-of-function polypeptide, the subject is administered the therapeutic agent that treats, prevents, or inhibits a metabolic disorder in a dosage amount that is the same as or less than a standard dosage amount, and is also administered an INHBE inhibitor. In some embodiments, the subject is INHBE reference. In some embodiments, the subject is heterozygous for an INHBE variant nucleic acid molecule encoding an INHBE predicted loss-of-function polypeptide. Furthermore, when the subject has a lower gene burden for having an INHBE variant nucleic acid molecule encoding an INHBE predicted loss-of-function polypeptide, and therefore has an increased risk of developing a metabolic disorder, the subject is administered a therapeutic agent that treats, prevents, or inhibits a metabolic disorder. In some embodiments, when the subject has a lower gene burden for having an INHBE variant nucleic acid molecule encoding an INHBE predicted loss-of-function polypeptide, the subject is administered the therapeutic agent that treats, prevents, or inhibits a metabolic disorder in a dosage amount that is the same as or greater than the standard dosage amount administered to a subject who has a greater gene burden for having an INHBE variant nucleic acid molecule encoding an INHBE predicted loss-of-function polypeptide.

In some embodiments, when a subject is identified as having an increased risk of developing a cardiovascular disease, the subject is further administered a therapeutic agent that treats, prevents, or inhibits a cardiovascular disease, and/or an INHBE inhibitor, as described herein. For example, when the subject is INHBE reference, and therefore has an increased risk of developing a cardiovascular disease, the subject is administered an INHBE inhibitor. In some embodiments, such a subject is also administered a therapeutic agent that treats, prevents, or inhibits a cardiovascular disease. In some embodiments, when the subject is heterozygous for an INHBE variant nucleic acid molecule encoding an INHBE predicted loss-of-function polypeptide, the subject is administered the therapeutic agent that treats, prevents, or inhibits a cardiovascular disease in a dosage amount that is the same as or less than a standard dosage amount, and is also administered an INHBE inhibitor. In some embodiments, the subject is INHBE reference. In some embodiments, the subject is heterozygous for an INHBE variant nucleic acid molecule encoding an INHBE predicted loss-of-function polypeptide. Furthermore, when the subject has a lower gene burden for having an INHBE variant nucleic acid molecule encoding an INHBE predicted loss-of-function polypeptide, and therefore has an increased risk of developing a cardiovascular disease, the subject is administered a therapeutic agent that treats, prevents, or inhibits a cardiovascular disease. In some embodiments, when the subject has a lower gene burden for having an INHBE variant nucleic acid molecule encoding an INHBE predicted loss-of-function polypeptide, the subject is administered the therapeutic agent that treats, prevents, or inhibits a cardiovascular disease in a dosage amount that is the same as or greater than the standard dosage amount administered to a subject who has a greater gene burden for having an INHBE variant nucleic acid molecule encoding an INHBE predicted loss-of-function polypeptide.

The present disclosure also provides methods of diagnosing a metabolic disorder in a subject. The methods comprise determining or having determined whether the subject has any one or more of the INHBE variant nucleic acid molecules or polypeptides produced therefrom described herein. When the subject is INHBE reference, and has one or more symptoms of a metabolic disorder, the subject is diagnosed as having a metabolic disorder. In some embodiments, the subject is homozygous for a reference INHBE nucleic acid molecule. In some embodiments, the subject is homozygous or heterozygous for an INHBE variant nucleic acid molecule encoding a predicted loss-of-function INHBE polypeptide. In some embodiments, when a subject is identified as having metabolic disorder (such as having one or more symptoms of metabolic disorder and being homozygous or heterozygous for an INHBE variant nucleic acid molecule encoding a predicted loss-of-function INHBE polypeptide), the subject is further treated with a therapeutic agent that treats or inhibits the metabolic disorder, such as any of those described herein.

The present disclosure also provides methods of diagnosing a cardiovascular disease in a subject. The methods comprise determining or having determined whether the subject has any one or more of the INHBE variant nucleic acid molecules or polypeptides produced therefrom described herein. When the subject is INHBE reference, and has one or more symptoms of a cardiovascular disease, the subject is diagnosed as having a cardiovascular disease. In some embodiments, the subject is homozygous for a reference INHBE nucleic acid molecule. In some embodiments, the subject is homozygous or heterozygous for an INHBE variant nucleic acid molecule encoding a predicted loss-of-function INHBE polypeptide. In some embodiments, when a subject is identified as having cardiovascular disease (such as having one or more symptoms of cardiovascular disease and being homozygous or heterozygous for an INHBE variant nucleic acid molecule encoding a predicted loss-of-function INHBE polypeptide), the subject is further treated with a therapeutic agent that treats or inhibits the cardiovascular disease, such as any of those described herein.

The present disclosure also provides methods of identifying a subject having an increased risk for developing a metabolic disorder, wherein the method comprises determining or having determined in a biological sample obtained from the subject the presence or absence of an INHBE predicted loss-of-function polypeptide. In some embodiments, the method is a blood based quantitative assay, such as a somalogic assay to quantify inhibin E.

The present disclosure also provides methods of identifying a subject having an increased risk for developing a cardiovascular disease, wherein the method comprises determining or having determined in a biological sample obtained from the subject the presence or absence of an INHBE predicted loss-of-function polypeptide. In some embodiments, the method is a blood based quantitative assay, such as a somalogic assay to quantify inhibin E.

The presence of INHBE polypeptides in suitable fluid samples, such as blood, plasma, and/or serum, can be determined by detecting the INHBE polypeptide using numerous methods for measuring INHBE or INHBE activity. For example, INHBE polypeptide can be detected by immunoassays using antibodies specific for INHBE. The antibody being capable of binding selectively to an INHBE polypeptide and/or CEA. The antibody can be used, for example, in Western blots of one- or two-dimensional gels, in high throughput methods such as enzyme linked immunoassay and/or in dot blot (Antibody Sandwich) assays of total cellular protein, or partially purified protein. In some embodiments, the concentration of INHBE in a suitable fluid is measured by an enzyme-linked immunosorbent assay (ELISA). In one example of the assay, a serum sample is diluted 400-fold and applied to a plate to which INHBE polypeptide antibodies from one animal origin (primary antibody) are attached. If enough INHBE is present in the serum, the INHBE may bind to these INHBE antibodies. The plate is then washed to remove all other components of the serum. A specially prepared "secondary antibody", such as from an animal origin different from that of the primary antibody, an antibody that binds to the primary antibody—is then applied to the plate, followed by another wash. This secondary antibody is chemically linked in advance to, for example, an enzyme. Thus, the plate will contain enzyme in proportion to the amount of secondary antibody bound to the plate. A substrate for the enzyme is applied, and catalysis by the enzyme leads to a change in color or fluorescence. Samples that generate a signal that is stronger than the known healthy sample are "positive". Those that generate weaker signal than the known healthy sample are "negative."

Alternately, the concentration of INHBE polypeptide in a suitable fluid can be determined by detecting the INHBE polypeptide using spectrometric methods, such as LC-MS/MS mass spectrometer, GCMS mass spectrometer, SDS PAGE methods later quantified with densitometry or mass spectrometry methods or any similar methods of quantifying proteins. Additional methods of quantifying polypeptide levels include, but are not limited to, HPLC (high performance liquid chromatography), SEC (size exclusion chromatography), modified Lowry assay, spectrophotometry, SEC-MALLS (size exclusion chromatography/multi-angle laser light scattering), and NMR (nuclear magnetic resonance).

Aptamers specific for INHBE polypeptides can also be used. A suitable aptamer is capable of binding selectively an INHBE polypeptide for measuring blood, plasma or serum concentration of INHBE polypeptide, or for detecting the presence of a variant INHBE. An INHBE polypeptide produced recombinantly or by chemical synthesis, and fragments or other derivatives or analogs thereof, including fusion proteins, may be used as an immunogen to generate aptamers that recognize the INHBE polypeptide. The term "aptamer" refers to a non-naturally occurring oligonucleotide chain or peptide molecule that has a specific action on a target compound (such as a specific epitope, therapeutic drug marker or surrogate marker). A specific action includes, but is not limited to, binding of the target compound, catalytically changing the target compound, and/or reacting with the target compound in a way that modifies/alters the target compound or the functional activity of the target compound. Aptamers can be engineered through repeated rounds of in vitro selection or SELEX™ (systematic evolution of ligands by exponential enrichment) to bind to various molecular targets such as small molecules. Methods for production/synthesis are described in, for example: Ellington et al., Nature, 1990, 346, 818-822; and Tuerk et al., Science, 1990, 249, 505-510. The "SELEX™" methodology involves the combination of selected nucleic acid ligands, which interact with a specific epitope in a desired action, for example binding to a protein, with amplification of those selected nucleic acids. Optional iterative cycling of the selection/amplification steps allows selection of one or a small number of nucleic acids, which interact most strongly with the specific epitope from a pool, which contains a very large number of nucleic acids. Cycling of the selection/amplification procedure is continued until a selected goal is achieved. The SELEX methodology is described in the following U.S. Pat. Nos. 5,475,096 and 5,270,163.

The present disclosure also provides methods of identifying a subject having a disease, such as a metabolic disorder, who may respond differentially to treatment with an INHBE inhibitor or other therapeutic agent affecting fat distribution. In some embodiments, the method comprises determining or having determined in a biological sample (liver, plasma, serum, and/or whole blood) obtained from the subject the presence or absence of an INHBE pLOF or pGOF or that are associated with liver expression of INHBE or measurement of INHBE in circulation or expression in liver. When the subject lacks such an INHBE variant (i.e., the subject is genotypically categorized as an INHBE reference), then the subject has an increased risk for developing a metabolic disorder and may be amenable to treatment with an INHBE inhibitor or other therapeutic agent affecting fat distribution. When the subject has such an INHBE variant nucleic acid molecule (i.e., the subject is heterozygous for an INHBE pLOF/pGOF or homozygous for an INHBE pLOF/pGOF), then the subject has a decreased risk for developing a metabolic disorder.

The present disclosure also provides methods of detecting the presence or absence of an INHBE variant nucleic acid molecule (genomic, mRNA, or cDNA) encoding a predicted loss-of-function INHBE polypeptide in a biological sample from a subject. It is understood that gene sequences within a population and mRNA molecules encoded by such genes can vary due to polymorphisms such as single-nucleotide polymorphisms.

The biological sample can be derived from any cell, tissue, or biological fluid from the subject. The sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The sample used in the methods disclosed herein will vary based on the assay format, nature of the detection method, and the tissues, cells, or extracts that are used as the sample. A biological sample can be processed differently depending on the assay being employed. For example, when detecting any predicted loss-of-function variant INHBE nucleic acid molecule, preliminary processing designed to isolate or enrich the sample for the genomic DNA can be employed. A variety of techniques may be used for this purpose. When detecting the level of any predicted loss-of-function variant INHBE mRNA, different techniques can be used enrich the biological sample with mRNA. Various methods to detect the presence or level of an mRNA or the presence of a particular variant genomic DNA locus can be used.

In some embodiments, detecting an INHBE variant nucleic acid molecule encoding a predicted loss-of-function INHBE polypeptide in a subject comprises assaying or genotyping a biological sample obtained from the subject to determine whether an INHBE genomic nucleic acid molecule in the biological sample, and/or an INHBE mRNA molecule in the biological sample, and/or an INHBE cDNA molecule produced from an mRNA molecule in the biological sample, comprises one or more variations that cause a loss-of-function (partial or complete) or are predicted to cause a loss-of-function (partial or complete), such as any of the INHBE variant nucleic acid molecules encoding a predicted loss-of-function INHBE polypeptide described herein.

In some embodiments, the methods of detecting the presence or absence of an INHBE variant nucleic acid molecule (such as, for example, a genomic nucleic acid molecule, an mRNA molecule, and/or a cDNA molecule produced from an mRNA molecule) in a subject, comprise performing an assay on a biological sample obtained from the subject. The assay determines whether a nucleic acid molecule in the biological sample comprises a particular nucleotide sequence.

In some embodiments, the biological sample comprises a cell or cell lysate. Such methods can further comprise, for example, obtaining a biological sample from the subject comprising an INHBE genomic nucleic acid molecule or mRNA molecule, and if mRNA, optionally reverse transcribing the mRNA into cDNA. Such assays can comprise, for example determining the identity of these positions of the particular INHBE nucleic acid molecule. In some embodiments, the method is an in vitro method.

In some embodiments, the determining step, detecting step, or genotyping assay comprises sequencing at least a portion of the nucleotide sequence of the INHBE genomic nucleic acid molecule, the INHBE mRNA molecule, or the INHBE cDNA molecule in the biological sample, wherein the sequenced portion comprises one or more variations that cause a loss-of-function (partial or complete) or are predicted to cause a loss-of-function (partial or complete), such as any of the predicted loss-of-function variant INHBE nucleic acid molecules described herein.

In some embodiments, the determining step, detecting step, or genotyping assay comprises sequencing at least a portion of the nucleotide sequence of the INHBE genomic nucleic acid molecule in the biological sample, the nucleotide sequence of the INHBE mRNA molecule in the biological sample, or the nucleotide sequence of the INHBE cDNA molecule produced from the INHBE mRNA in the biological sample. In some embodiments, the determining step, detecting step, or genotyping assay comprises sequencing at least a portion of the nucleotide sequence of the INHBE genomic nucleic acid molecule in the biological sample. In some embodiments, the determining step, detecting step, or genotyping assay comprises sequencing at least a portion of the nucleotide sequence of the INHBE mRNA molecule in the biological sample. In some embodiments, the determining step, detecting step, or genotyping assay comprises sequencing at least a portion of the nucleotide sequence of the INHBE cDNA molecule produced from the INHBE mRNA molecule in the biological sample.

In some embodiments, the assay comprises sequencing the entire nucleic acid molecule. In some embodiments, only an INHBE genomic nucleic acid molecule is analyzed. In some embodiments, only an INHBE mRNA is analyzed. In some embodiments, only an INHBE cDNA obtained from INHBE mRNA is analyzed.

In some embodiments, the determining step, detecting step, or genotyping assay comprises: a) amplifying at least a portion of the nucleic acid molecule that encodes the INHBE polypeptide; b) labeling the amplified nucleic acid molecule with a detectable label; c) contacting the labeled nucleic acid molecule with a support comprising an alteration-specific probe; and d) detecting the detectable label.

In some embodiments, the nucleic acid molecule is mRNA and the determining step further comprises reverse-transcribing the mRNA into a cDNA prior to the amplifying step.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule; and detecting the detectable label. Alteration-specific polymerase chain reaction techniques can be used to detect mutations such as SNPs in a nucleic acid sequence. Alteration-specific primers can be used because the DNA polymerase will not extend when a mismatch with the template is present.

In some embodiments, the nucleic acid molecule in the sample is mRNA and the mRNA is reverse-transcribed into a cDNA prior to the amplifying step. In some embodiments, the nucleic acid molecule is present within a cell obtained from the subject.

In some embodiments, the assay comprises contacting the biological sample with a primer or probe, such as an alteration-specific primer or alteration-specific probe, that specifically hybridizes to an INHBE variant nucleic acid molecule (genomic, mRNA, or cDNA) and not the corresponding INHBE reference sequence under stringent conditions, and determining whether hybridization has occurred. In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising an INHBE variant nucleic acid molecule (genomic, mRNA, or cDNA) encoding a predicted loss-of-function INHBE polypeptide. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneously with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. In some embodiments, a polynucleotide primer or probe under stringent conditions will hybridize to its target nucleotide sequence to a detectably greater degree than to other nucleotide sequences by at least 2-fold. In some embodiments, a polynucleotide primer or probe under stringent conditions will hybridize to its target nucleotide sequence to a detectably greater degree than to other nucleotide sequences by at least 3-fold. In some embodiments, a polynucleotide primer or probe under stringent conditions will hybridize to its target nucleotide sequence to a detectably greater degree than to other nucleotide sequences by at least 4-fold. In some embodiments, a polynucleotide primer or probe under stringent conditions will hybridize to its target nucleotide sequence to a detectably greater degree than to other nucleotide sequences by over 10-fold over background. Stringent conditions are sequence-dependent and will be different in different circumstances.

Appropriate stringency conditions which promote DNA hybridization, for example, 6× sodium chloride/sodium citrate (SSC) at about 45° C., followed by a wash of 2×SSC at 50° C., are known or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M Na$^+$ ion, typically about 0.01 to 1.0 M Na$^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The present disclosure also provides methods of detecting the presence of a human INHBE predicted loss-of-function polypeptide comprising performing an assay on a sample obtained from a subject to determine whether an INHBE polypeptide in the subject contains one or more variations that causes the polypeptide to have a loss-of-function (partial or complete) or predicted loss-of-function (partial or complete).

In some embodiments, the detecting step comprises sequencing at least a portion of the polypeptide. In some embodiments, the detecting step comprises an immunoassay for detecting the presence of a polypeptide.

In some embodiments, when the subject does not have an INHBE predicted loss-of-function polypeptide, then the subject has an increased risk for developing a metabolic disorder or any of type 2 diabetes, lipodystrophy, liver inflammation, fatty liver disease, hypercholesterolemia, elevated liver enzymes (such as, for example, ALT and/or AST), obesity, high blood pressure, NASH, and/or elevated triglyceride level. In some embodiments, when the subject has an INHBE predicted loss-of-function polypeptide, then the subject has a decreased risk for developing a metabolic disorder or any of type 2 diabetes, obesity, lipodystrophy, liver inflammation, fatty liver disease, hypercholesterolemia, elevated liver enzymes (such as, for example, ALT and/or AST), high blood pressure, NASH, and/or elevated triglyceride level.

In some embodiments, when the subject does not have an INHBE predicted loss-of-function polypeptide, then the subject has an increased risk for developing a cardiovascular disease or any of cardiomyopathy, heart failure, and high blood pressure. In some embodiments, when the subject has an INHBE predicted loss-of-function polypeptide, then the subject has a decreased risk for developing a cardiovascular disease or any of cardiomyopathy, heart failure, and high blood pressure.

The present disclosure also provides uses of isolated nucleic acid molecules that hybridize to INHBE variant genomic nucleic acid molecules, INHBE variant mRNA molecules, and/or INHBE variant cDNA molecules (such as any of the genomic variant nucleic acid molecules, mRNA variant molecules, and cDNA variant molecules disclosed herein) in any of the methods described herein.

In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, or at least about 5000 nucleotides. In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides. In some embodiments, the isolated nucleic acid molecules comprise or consist of at least about 18 nucleotides. In some embodiments, the isolated nucleic acid molecules comprise or consists of at least about 15 nucleotides. In some embodiments, the isolated nucleic acid molecules consist of or comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides. In some embodiments, the isolated nucleic acid molecules consist of or comprise from about 18 to about 30 nucleotides. In some embodiments, the isolated nucleic acid molecules comprise or consist of at least about 15 nucleotides to at least about 35 nucleotides.

In some embodiments, such isolated nucleic acid molecules hybridize to INHBE variant nucleic acid molecules (such as genomic nucleic acid molecules, mRNA molecules, and/or cDNA molecules) under stringent conditions. Such nucleic acid molecules can be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein, and can be used in any of the methods described herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to INHBE variant genomic nucleic acid molecules, INHBE variant mRNA molecules, and/or INHBE variant cDNA molecules. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can be used to detect a nucleotide variation within any of the INHBE variant genomic nucleic acid molecules, INHBE variant mRNA molecules, and/or INHBE variant cDNA molecules disclosed herein. The primers described herein can be used to amplify INHBE variant genomic nucleic acid molecules, INHBE variant mRNA molecules, or INHBE variant cDNA molecules, or a fragment thereof.

In the context of the disclosure "specifically hybridizes" means that the probe or primer (such as, for example, the alteration-specific probe or alteration-specific primer) does not hybridize to a nucleic acid sequence encoding an INHBE reference genomic nucleic acid molecule, an INHBE reference mRNA molecule, and/or an INHBE reference cDNA molecule.

In some embodiments, the probes (such as, for example, an alteration-specific probe) comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well.

The nucleotide sequence of an INHBE reference genomic nucleic acid molecule is set forth in SEQ ID NO:1 (ENST00000266646.3 encompassing chr12:57455307-57458025 in the GRCh38/hg38 human genome assembly).

The nucleotide sequence of an INHBE reference mRNA molecule is set forth in SEQ ID NO:2. The nucleotide sequence of another INHBE reference mRNA molecule is set forth in SEQ ID NO:3. The nucleotide sequence of another INHBE reference mRNA molecule is set forth in SEQ ID NO:4.

The nucleotide sequence of an INHBE reference cDNA molecule is set forth in SEQ ID NO:5. The nucleotide sequence of another INHBE reference cDNA molecule is set forth in SEQ ID NO:6. The nucleotide sequence of another INHBE reference cDNA molecule is set forth in SEQ ID NO:7.

The amino acid sequence of an INHBE reference polypeptide is set forth in SEQ ID NO:8. Referring to SEQ ID NO:8, the INHBE reference polypeptide is 350 amino acids in length.

The genomic nucleic acid molecules, mRNA molecules, and cDNA molecules can be from any organism. For example, the genomic nucleic acid molecules, mRNA molecules, and cDNA molecules can be human or an ortholog from another organism, such as a non-human mammal, a rodent, a mouse, or a rat. It is understood that gene sequences within a population can vary due to polymorphisms such as single-nucleotide polymorphisms. The examples provided herein are only exemplary sequences. Other sequences are also possible.

The isolated nucleic acid molecules disclosed herein can comprise RNA, DNA, or both RNA and DNA. The isolated nucleic acid molecules can also be linked or fused to a heterologous nucleic acid sequence, such as in a vector, or a heterologous label. For example, the isolated nucleic acid molecules disclosed herein can be within a vector or as an exogenous donor sequence comprising the isolated nucleic acid molecule and a heterologous nucleic acid sequence. The isolated nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, $—O[(CH_2)_nO]_mCH_3$, $—O(CH_2)_nOCH_3$, $—O(CH_2)_nNH_2$, $—O(CH_2)_nCH_3$, $—O(CH_2)_n—ONH_2$, and $—O(CH_2)_nON[(CH_2)_nCH_3)]_2$, where n and m are from 1 to about 10. Other modifications at the 2' position include, but are not limited to, $C_{1-10}$alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

The present disclosure also provides therapeutic agents that treat or inhibit a metabolic disorder for use in the treatment of the metabolic disorder in a subject having: an INHBE variant genomic nucleic acid molecule encoding a predicted loss-of-function INHBE polypeptide; an INHBE variant mRNA molecule encoding a predicted loss-of-function INHBE polypeptide; or an INHBE variant cDNA molecule encoding a predicted loss-of-function INHBE polypeptide.

In some embodiments, the metabolic disorder is type 2 diabetes, and the therapeutic agent is chosen from metformin, insulin, glyburide, glipizide, glimepiride, repaglinide, nateglinide, thiazolidinediones, rosiglitazone, pioglitazone, sitagliptin, saxagliptin, linagliptin, exenatide, liraglutide, semaglutide, canagliflozin, dapagliflozin, and empagliflozin.

In some embodiments, the metabolic disorder is obesity, and the therapeutic agent is chosen from orlistat, phentermine, topiramate, bupropion, naltrexone, and liraglutide.

In some embodiments, the metabolic disorder is high blood pressure, and the therapeutic agent is chosen from chlorthalidone, chlorothiazide, hydrochlorothiazide, indapamide, metolazone, acebutolol, atenolol, betaxolol, bisoprolol fumarate, carteolol hydrochloride, metoprolol tartrate, metoprolol succinate, nadolol, benazepril hydrochloride, captopril, enalapril maleate, fosinopril sodium, lisinopril, moexipril, perindopril, quinapril hydrochloride, ramipril, trandolapril, candesartan, eprosartan mesylate, irbesartan, losartan potassium, telmisartan, valsartan, amlodipine besylate, bepridil, diltiazem hydrochloride, felodipine, isradipine, nicardipine, nifedipine, nisoldipine, verapamil hydrochloride, doxazosin mesylate, prazosin hydrochloride, terazosin hydrochloride, methyldopa, carvedilol labetalol hydrochloride, alpha methyldopa, clonidine hydrochloride, guanabenz acetate, guanfacine hydrochloride, guanadrel, guanethidine monosulfate, reserpine, hydralazine hydrochloride, and minoxidil.

In some embodiments, the metabolic disorder is elevated triglyceride, and the therapeutic agent is chosen from rosuvastatin, simvastatin, atorvastatin, fenofibrate, gemfibrozil, fenofibric acid, niacin, and an omega-3 fatty acid.

In some embodiments, the metabolic disorder is lipodystrophy, and the therapeutic agent is chosen from EGRIFTA® (tesamorelin), GLUCOPHAGE® (metformin), SCULPTRA® (poly-L-lactic acid), RADIESSE® (calcium hydroxyapatite), polymethylmethacrylate (e.g., PMMA), ZYDERM® (bovine collagen), COSMODERM® (human collagen), silicone, and hyaluronic acid. In some embodiments, the therapeutic agent that treats or inhibits lipodystrophy include, but are not limited to: tesamorelin, metformin, poly-L-lactic acid, a calcium hydroxyapatite, polymethylmethacrylate, a bovine collagen, a human collagen, silicone, and hyaluronic acid.

In some embodiments, the metabolic disorder is liver inflammation, and the therapeutic agent is chosen from hepatitis therapeutics and hepatitis vaccines.

In some embodiments, the metabolic disorder is fatty liver disease include, and the therapeutic agent or procedure is bariatric surgery and/or dietary intervention.

In some embodiments, the metabolic disorder is hypercholesterolemia, and the therapeutic agent is chosen from: statins (e.g., LIPITOR® (atorvastatin), LESCOL® (fluvastatin), lovastatin, LIVALO® (pitavastatin), PRAVACHOL® (pravastatin), CRESTOR® (rosuvastatin calcium), and ZOCOR® (simvastatin)); bile acid sequestrants (e.g., PREVALITE® (cholestyramine), WELCHOL® (colesevelam), and COLESTID® (colestipol)); PCSK9 Inhibitors (e.g., PRALUENT® (alirocumab) and REPATHA® (evolocumab); niacin (e.g., niaspan and niacor); fibrates (e.g., fenofibrate and LOPID® (gemfibrozil)); and ATP Citrate Lyase (ACL) Inhibitors (e.g., NEXLETOL® (bempedoic)). In some embodiments, the therapeutic agent that treats or inhibits hypercholesterolemia include, but are not limited to: statins (e.g., atorvastatin, fluvastatin, lovastatin, pitavastatin, pravastatin, rosuvastatin calcium, and simvastatin); bile acid sequestrants (e.g., cholestyramine, colesevelam, and colestipol); PCSK9 Inhibitors (e.g., alirocumab and evolocumab; niacin (e.g., niaspan and niacor); fibrates (e.g., fenofibrate and gemfibrozil); and ACL Inhibitors (e.g., bempedoic). In some embodiments, the therapeutic agent that treats or inhibits hypercholesterolemia is alirocumab or evolocumab. In some embodiments, the therapeutic agent that treats or inhibits hypercholesterolemia is alirocumab. In some embodiments, the therapeutic agent that treats or inhibits hypercholesterolemia is evolocumab.

In some embodiments, the metabolic disorder is elevated liver enzymes (such as, for example, ALT and/or AST), and the therapeutic agent is chosen from coffee, folic acid, potassium, vitamin B6, a statin, and fiber, or any combination thereof.

In some embodiments, the metabolic disorder is NASH and the therapeutic agent is obeticholic acid, Selonsertib, Elafibranor, Cenicriviroc, GR_MD_02, MGL_3196, IMM124E, arachidyl amido cholanoic acid, GS0976, Emricasan, Volixibat, NGM282, GS9674, Tropifexor, MN_001, LMB763, BI_1467335, MSDC_0602, PF_05221304, DF102, Saroglitazar, BMS986036, Lanifibranor, Semaglutide, Nitazoxanide, GRI_0621, EYP001, VK2809, Nalmefene, LIK066, MT_3995, Elobixibat, Namodenoson, Foralumab, SAR425899, Sotagliflozin, EDP_305, Isosabutate, Gemcabene, TERN_101, KBP_042, PF_06865571, DUR928, PF_06835919, NGM313, BMS_986171, Namacizumab, CER_209, ND_L02_s0201, RTU_1096, DRX_065, IONIS_DGAT2Rx, INT_767, NC_001, Seladepar, PXL770, TERN_201, NV556, AZD2693, SP_1373, VK0214, Hepastem, TGFTX4, RLBN1127, GKT_137831, RYI_018, CB4209-CB4211, and JH_0920.

In some embodiments, the therapeutic agent that treats or inhibits the metabolic disorder is a melanocortin 4 receptor (MC4R) agonist. In some embodiments, the MC4R agonist comprises a protein, a peptide, a nucleic acid molecule, or a small molecule. In some embodiments, the protein is a peptide analog of MC4R. In some embodiments, the peptide is setmelanotide. In some embodiments, the MC4R agonist is a peptide comprising the amino acid sequence His-Phe-Arg-Trp. In some embodiments, the small molecule is 1,2,3R,4-tetrahydroisoquinoline-3-carboxylic acid. In some embodiments, the MC4R agonist is ALB-127158(a).

The present disclosure also provides therapeutic agents that treat or inhibit a cardiovascular disease for use in the treatment of the cardiovascular disease in a subject having: an INHBE variant genomic nucleic acid molecule encoding a predicted loss-of-function INHBE polypeptide; an INHBE variant mRNA molecule encoding a predicted loss-of-function INHBE polypeptide; or an INHBE variant cDNA molecule encoding a predicted loss-of-function INHBE polypeptide.

In some embodiments, the cardiovascular disease is high blood pressure, and the therapeutic agent is chosen from chlorthalidone, chlorothiazide, hydrochlorothiazide, indapamide, metolazone, acebutolol, atenolol, betaxolol, bisoprolol fumarate, carteolol hydrochloride, metoprolol tartrate, metoprolol succinate, nadolol, benazepril hydrochloride, captopril, enalapril maleate, fosinopril sodium, lisinopril, moexipril, perindopril, quinapril hydrochloride, ramipril, trandolapril, candesartan, eprosartan mesylate, irbesartan, losartan potassium, telmisartan, valsartan, amlodipine besylate, bepridil, diltiazem hydrochloride, felodipine, Isradipine, nicardipine, nifedipine, nisoldipine, verapamil hydrochloride, doxazosin mesylate, prazosin hydrochloride, terazosin hydrochloride, methyldopa, carvedilol labetalol hydrochloride, alpha methyldopa, clonidine hydrochloride, guanabenz acetate, guanfacine hydrochloride, guanadrel, guanethidine monosulfate, reserpine, hydralazine hydrochloride, and minoxidil.

In some embodiments, the cardiovascular disease is cardiomyopathy, and the cardiovascular agent is chosen from: 1) blood pressure lowering agents, such as ACE inhibitors, angiotensin II receptor blockers, beta blockers, and calcium channel blockers; 2) agents that slow heart rate, such as beta blockers, calcium channel blockers, and digoxin; 3) agents that keep the heart beating with a normal rhythm, such as antiarrhythmics; 4) agents that balance electrolytes, such as aldosterone blockers; 5) agents that remove excess fluid and sodium from the body, such as diuretics; 6) agents that prevent blood clots from forming, such as anticoagulants or blood thinners; and 7) agents that reduce inflammation, such as corticosteroids.

In some embodiments, the cardiovascular disease is heart failure, and the therapeutic agent is chosen from: an ACE inhibitor, an angiotensin-2 receptor blocker, a beta blocker, a mineralocorticoid receptor antagonist, a diuretic, ivabradine, sacubitril valsartan, hydralazine with nitrate, and digoxin.

The present disclosure also provides INHBE inhibitors that treat or inhibit a metabolic disorder for use in the treatment of the metabolic disorder in a subject having: an INHBE variant genomic nucleic acid molecule encoding a predicted loss-of-function INHBE polypeptide; an INHBE variant mRNA molecule encoding a predicted loss-of-function INHBE polypeptide; or an INHBE variant cDNA molecule encoding a predicted loss-of-function INHBE polypeptide.

The present disclosure also provides INHBE inhibitors that treat or inhibit a cardiovascular disease for use in the treatment of the cardiovascular disease in a subject having: an INHBE variant genomic nucleic acid molecule encoding a predicted loss-of-function INHBE polypeptide; an INHBE variant mRNA molecule encoding a predicted loss-of-function INHBE polypeptide; or an INHBE variant cDNA molecule encoding a predicted loss-of-function INHBE polypeptide.

In some embodiments, the INHBE inhibitor comprises an antisense nucleic acid molecule, a small interfering RNA (siRNA), or a short hairpin RNA (shRNA) that hybridizes to an INHBE mRNA. In some embodiments, the INHBE inhibitor comprises a Cas protein and guide RNA (gRNA) that hybridizes to a gRNA recognition sequence within an INHBE genomic nucleic acid molecule. In some embodiments, the Cas protein is Cas9 or Cpf1. In some embodiments, the gRNA recognition sequence is located within SEQ ID NO:1. In some embodiments, a Protospacer Adjacent Motif (PAM) sequence is about 2 to 6 nucleotides downstream of the gRNA recognition sequence. In some embodiments, the gRNA comprises from about 17 to about 23 nucleotides. In some embodiments, the gRNA recognition sequence comprises a nucleotide sequence according to any one of SEQ ID NOs:9-27.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in ° C. or is at ambient temperature, and pressure is at or near atmospheric.

EXAMPLES

Figure 2:
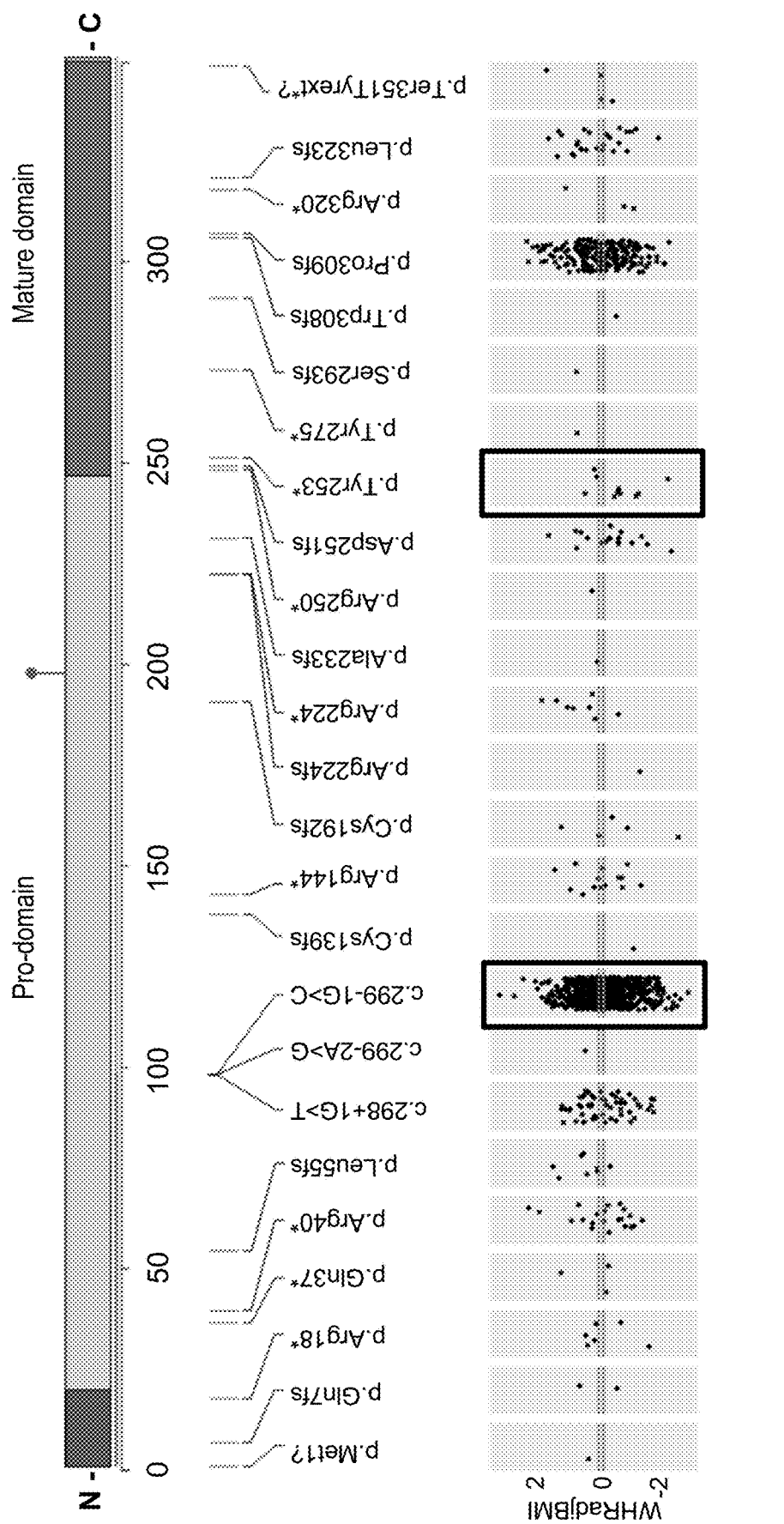
FIG. 2 depicts a gene model for INHBE showing the location of pLOF variants (top panel) and the phenotypic distribution of BMI-adjusted WHR in carriers of each variant; the top bar shows the median BMI-adjusted WHR in non-carriers, while the bottom bar shows the median BMI-adjusted WHR in carriers; two variants highlighted in boxes were individually associated with lower BMI-adjusted WHR; data are from the UK Biobank (UKB) and Mexico City Prospective Study (MCPS) cohorts; abbreviations: body mass index, BMI; waist-hip ratio, WHR.

Example 1: Loss of Function in INHBE is Associated with a More Favorable Fat Distribution and Protection Against Type 2 Diabetes in Humans An exome-wide association analysis for fat distribution, measured by the waist-to-hip circumference ratio adjusted for body mass index (BMI-adjusted WHR), was performed. BMI-adjusted WHR is a measure of body fat distribution independent of overall adiposity. For each gene in the genome, associations with BMI-adjusted WHR for the burden of rare predicted loss-of-function genetic variants (pLOF variants with alternative allele frequency [AAF] <1%) were estimated. In this analysis, the burden of rare (AAF<1%) predicted loss-of-function (pLOF) variants in INHBE was associated with a more favorable fat distribution (i.e., lower WHR adjusted for BMI; see, FIG. 1 and FIG. 2) at the exome-wide level of statistical significance ($p<3.6\times10^{-7}$, corresponding to a Bonferroni correction for the number of tests). Table 6 shows results of associations with fat distribution for pLOF variants in INHBE in 285,605 European ancestry participants in the UKB cohort (associations with BMI-adjusted WHR; genetic exposure is the burden of pLOF variants with AAF<1%). INHBE pLOF were strongly associated with lower BMI-adjusted WHR (see, Table 6). This statistically significant association was further replicated in a meta-analysis of additional data including a second tranche of UKB data (over 140,000 European ancestry participants) and over 95,000 admixed American participants from the MCPS study (see, FIG. 1).

TABLE 6

| INHBE gene-burden association result for BMI adjusted WHR in the UKB ||||| 
|---|---|---|---|---|
| AAF | Per allele effect (95% CI) in SD units | P-value | Genotype counts, RR\|RA\|AA genotypes | Per allele beta (95% CI) in BMI adjusted WHR units |
| 0.0012 | −0.21 (−0.29, −0.14) | 2.80E−08 | 285,605: 284,942\|663\|0 | −0.02 (−0.02, −0.01) |

Abbreviations: UKB=UK biobank study population, AAF=frequency of pLOF alleles across pLOF variants in the gene, RR=count of individuals having no heterozygous or homozygous observations of pLOFs variants in the gene, RA=count of individuals with at least one heterozygous pLOF and no homozygotes pLOF variants in the gene, AA=count of individuals with at least one homozygous pLOF variants in the gene, CI=confidence interval, pLOF=predicted loss-of-function, SD=standard deviation.

Table 6 shows the association of INHBE pLOF with BMI-adjusted WHR in the European ancestry individuals of the UK Biobank study population. The effect of INHBE pLOF variants was estimated in standard deviation (SD) units and in the ratio units of WHR. Table 6 shows that INHBE pLOF carriers have a lower BMI adjusted WHR compared to the average of individuals not carrying these genetic variants in analyses adjusting for covariates, ancestry and relatedness. Genotype counts display the number of individuals in the population studies carrying no variants leading to pLOF of INHBE (RR), one or more variants resulting in pLOF of a single INHBE allele (RA), or one or more pLOF variants in both INHBE alleles (AA).

This association of INHBE pLOF variants with lower BMI-adjusted WHR was consistent in men and women from the UK Biobank cohort (see, Table 7; genetic exposure is the burden of pLOF variants with AAF<1%).

TABLE 7

Sex-stratified INHBE pLOF variants association in the UKB

| Cohort (Sub-population) | AAF | Per allele effect (95% CI) in SD units | P-value | Genotype counts, RR\|RA\|AA genotypes | Per allele beta (95% CI) in BMI adjusted waist-hip ratio units |
|---|---|---|---|---|---|
| UKB (EUR women) | 0.001 | −0.19 (−0.27, −0.11) | 2.8E−06 | 232,890: 232,329\|561\|0 | −0.01 (−0.02, −0.01) |
| UKB (EUR men) | 0.001 | −0.16 (−0.25, −0.07) | 3.6E−04 | 196,500: 196,056\|444\|0 | −0.01 (−0.01, 0.005) |

Abbreviations: UKB=UK biobank study population, AAF=frequency of pLOF alleles across pLOF variants in the gene, RR=count of individuals having no heterozygous or homozygous observations of pLOFs variants in the gene, RA=count of individuals with at least one heterozygous pLOF and no homozygotes pLOF variants in the gene, AA=count of individuals with at least one homozygous pLOF variants in the gene, CI=confidence interval, pLOF=predicted loss of function, SD=standard deviation.

Table 7 shows the association of INHBE pLOF with BMI-adjusted WHR in European ancestry individuals from the UK Biobank study stratified by sex. The effect of INHBE pLOF variants was estimated in standard deviation (SD) units and in ratio units of WHR. Genotype counts display the number of individuals in the population studies carrying no variants leading to pLOF of INHBE (RR), one or more variants resulting in pLOF of a single INHBE allele (RA), or one or more pLOF variants in both INHBE alleles (AA). The association of INHBE pLOF variants with lower BMI-adjusted WHR was similarly strong in men and women included in this analysis.

Among pLOF variants in INHBE, the variant with the strongest association with BMI-adjusted WHR was a c.299-1G>C (12:57456093:G:C according to GRCh38/hg38 human genome assembly coordinates) mutation, predicted to affect the intron 1 acceptor splice site shortening exon 2 by 12 nucleotides at the 5' end (see, FIG. 3 and Table 8) and result in an in-frame deletion within the pro-domain of the INHBE protein (see, FIG. 4).

TABLE 8

Effect on splicing for the 12:57456093:G:C acceptor splice-site variant as predicted by the SpliceAI software.

| VARIANT | SPLICE CHANGE | DELTA SCORE |
|---|---|---|
| 12:57456093:G:C | Acceptor loss | 0.98 |
| | Acceptor gain | 0.9 |

Delta score: Value between 0-1, interpreted as the probability of the variant having a splice-change effect on the INHBE gene.

Table 8 shows the predicted effect of the variant 12:57456093:G:C on splicing of the INHBE gene.

In Chinese hamster ovary (CHO) cells, the c.299-1G>C splice variant was expressed and was found to result in a lower molecular weight protein that is not secreted outside the cell, indicating a loss-of-function (see, FIG. 5).

pLOF variants in INHBE were associated with larger hip circumference, higher arm and leg fat mass, suggestive of greater ability to store calories in peripheral adipose tissue (see, FIG. 6 and Table 9).

TABLE 9

Association of pLOF genetic variants in INHBE with adiposity phenotypes meta-analyzed across the UKB, Geisinger Health System (GHS) and MCPS studies

| Outcome (Clinical Units) | Genetic exposure | Per allele effect (95% CI) in SD units | P-value | Genotype counts RR\|RA\|AA genotypes | Per allele beta (95% CI) in clinical units |
|---|---|---|---|---|---|
| BMI (kg/m$^2$) | INHBE pLOF; AAF <1% | 0.06 (0.01, 0.11) | 0.02 | 645,626: 644,402\|1,224\|0 | 0.33 (0.04, 0.61) |
| Waist (cm) | | −0.03 (−0.09, 0.03) | 0.26 | 526,076: 525,034\|1,042\|0 | −0.45 (−1.22, 0.33) |
| Hip (cm) | | 0.07 (0.01, 0.13) | 0.03 | 526,031: 524,989\|1,042\|0 | 0.63 (0.08, 1.19) |

Abbreviations: UKB=UK biobank study population, GHS=Geisinger Health System study population, MCPS=Mexico City Prospective Study population, AAF=frequency of pLOF alleles across pLOF variants in the gene, RR=count of individuals having no heterozygous or homozygous observations of pLOFs variants in the gene, RA=count of individuals with at least one heterozygous pLOF and no homozygotes pLOF variants in the gene, AA=count of individuals with at least one homozygous pLOF variants in the gene, CI=confidence interval, pLOF=predicted loss-of-function, SD=standard deviation, kg/m$^2$=kilograms per meter square, cm=centimeters. Genotype counts display the number of individuals in the population studies carrying no variants leading to pLOF of INHBE (RR), one or more variants resulting in pLOF of a single INHBE allele (RA), or one or more pLOF variants in both INHBE alleles (AA).

Table 9 shows the association of INHBE pLOF with BMI, waist circumference, and hip circumference. The effect of INHBE pLOF is quantified in units of standard deviation, or in the respective clinical units of each anthropometric variable.

Rare pLOF variants in INHBE were also associated with protection against type 2 diabetes in humans. It was also found that INHBE pLOF variants were associated with lower risk of type 2 diabetes (T2D) (see, Table 10; genetic exposure is the burden of pLOF variants with AAF<1%), constituting the first evidence linking LOF in INHBE with type 2 diabetes in humans.

TABLE 10

Association of pLOF genetic variants in INHBE with T2D in the UKB, GHS and MCPS studies

| Cohort | AAF | Per allele OR (95% CI) | P-value | Genotype counts RR\|RA\|AA genotypes (cases) | Genotype counts RR\|RA\|AA genotypes (controls) |
|---|---|---|---|---|---|
| UKB | 0.001 | 0.82 (0.62, 1.08) | 0.15 | 23,907: 23,862\|45\|0 | 402,934: 401,981\|953\|0 |
| GHS | 0.001 | 0.44 (0.28, 0.70) | 0.0006 | 25,846: 25,828\|18\|0 | 63,749: 63,639\|110\|0 |

TABLE 10-continued

Association of pLOF genetic variants in INHBE with T2D in the UKB, GHS and MCPS studies

| Cohort | AAF | Per allele OR (95% CI) | P-value | Genotype counts RR\|RA\|AA genotypes (cases) | Genotype counts RR\|RA\|AA genotypes (controls) |
|---|---|---|---|---|---|
| MCPS | 0.0002 | 0.38 (0.13, 1.11) | 0.08 | 13,739: 13,738\|1\|0 | 83,278: 83,243\|35\|0 |
| Meta-analysis | 0.001 | 0.68 (0.54, 0.85) | 0.00097 | 63,492: 63,428\|64\|0 | 549,961: 548,863\|1,098\|0 |

Abbreviations: Meta-analysis=Joint analysis of all listed study populations, AAF=frequency of pLOF alleles across pLOF variants in the gene, RR=count of individuals having no heterozygous or homozygous observations of pLOFs variants in the gene, RA=count of individuals with at least one heterozygous pLOF and no homozygotes pLOF variants in the gene, AA=count of individuals with at least one homozygous pLOF variants in the gene, CI=confidence interval, pLOF=predicted loss-of-function, SD=standard deviation. Genotype counts display the number of individuals in the population studies either being cases of T2D or not in the T2D category carrying no variants leading to pLOF of INHBE (RR), one or more variants resulting in pLOF of a single INHBE allele (RA), or one or more pLOF variants in both INHBE alleles (AA).

Table 10 shows the association with T2D for pLOF variants in INHBE from an analysis of the UK Biobank (UKB), Geisinger Health System (GHS), and Mexico City Prospective study (MCPS) populations. The results show that, within each study population, INHBE pLOF variants were associated with lower risk of T2D and this was confirmed in a meta-analysis which combines results across all three study populations.

Furthermore, INHBE pLOF variants were associated with a favorable metabolic profile in an analysis across multiple cohorts (see, Table 11; genetic exposure is the burden of INHBE pLOF variants with AAF<1%), including lower HbA1c, ALT, triglycerides and LDL-C and higher HDL-C.

TABLE 11

Association of pLOF genetic variants in INHBE with metabolic meta-analyzed across the UKB, GHS and MCPS studies

| Outcome (Clinical Units) | AAF | Per allele effect (95% CI) in SD units | P-value | Genotype counts RR\|RA\|AA genotypes | Per allele beta (95% CI) in Clinical Units |
|---|---|---|---|---|---|
| Glucose (mg/dL) | 0.001 | 0.04 (−0.02, 0.10) | 0.24 | 460,195\|1,023\|0 | 0.76 (−0.51, 2.03) |
| HbA1c (%) | 0.001 | −0.06 (−0.11, −0.003) | 0.038 | 574,104\|1,086\|0 | −0.05 (−0.10, −0.003) |
| AST (U/L) | 0.001 | 0.0028 (−0.05, 0.06) | 0.92 | 514,592\|1,122\|0 | 0.03 (−0.5, 0.6) |
| ALT (U/L) | 0.001 | −0.07 (−0.13, −0.01) | 0.014 | 517,194\|1,123\|0 | −1.0 (−1.7, −0.2) |
| Triglycerides (mg/dL) | 0.001 | −0.11 (−0.16, −0.05) | 0.00017 | 500,594\|1,092\|0 | −9.2 (−14.1, −4.4) |
| HDL-C (mg/dL) | 0.001 | 0.13 (0.08, 0.19) | $3.1 \times 10^{-06}$ | 466,201\|1,024\|0 | 2.0 (1.1, 2.8) |
| LDL-C (mg/dL) | 0.001 | −0.06 (−0.11, −0.003) | 0.04 | 499,334\|1,092\|0 | −1.9 (−3.7, −0.1) |

Abbreviations: UKB=UK biobank study population, GHS=Geisinger Health System study population, MCPS=Mexico City Prospective Study, AAF=frequency of pLOF alleles across pLOF variants in the gene, RR=count of individuals having no heterozygous or homozygous observations of pLOFs variants in the gene, RA=count of individuals with at least one heterozygous pLOF and no homozygotes pLOF variants in the gene, AA=count of individuals with at least one homozygous pLOF variants in the gene, CI=confidence interval, pLOF=predicted loss-of-function, SD=standard deviation, mg/dL=milligrams per deciliter, U/L=Units per liter. Genotype counts display the number of individuals in the population studies carrying no variants leading to pLOF of INHBE (RR), one or more variants resulting in pLOF of a single INHBE allele (RA), or one or more pLOF variants in both INHBE alleles (AA).

Table 11 shows the association of INHBE pLOF variants with a range of metabolic phenotypes as estimated in a meta-analysis of the UKB, GHS, and MCPS study populations. Results are shown both in units of standard deviation, and in the original clinical units of the relevant metabolic phenotype.

In addition, INHBE pLOF variants were associated with reduced liver inflammation indices at magnetic resonance imaging (see, Table 12; genetic exposure is the burden of INHBE pLOF variants with AAF<1%).

TABLE 12

Association of pLOF genetic variants in INHBE with liver imaging phenotypes in the UKB

| Outcome (Clinical Units) | Effect (95% CI) in SD units | Effect (95% CI) in Clinical units | P-value | Allele count cases | AAF | ALT allele carriers % |
|---|---|---|---|---|---|---|
| ECF (Fraction of sampled pixels) | −0.25 (−0.47, −0.03) | −0.012 (−0.029, −0.002) | 0.026 | 36,690\|70\|0 | 0.00095 | 0.19% |

TABLE 12-continued

Association of pLOF genetic variants in INHBE with liver imaging phenotypes in the UKB

| Outcome (Clinical Units) | Effect (95% CI) in SD units | Effect (95% CI) in Clinical units | P-value | Allele count cases | AAF | ALT allele carriers % |
|---|---|---|---|---|---|---|
| ECF adjusted[a] (Fraction of sampled pixels) | −0.29 (−0.50, −0.08) | −0.018 (−0.031, −0.005) | 0.0060 | 35,205\|69\|0 | 0.00098 | 0.20% |
| PDFF (Fraction of sampled pixels) | 0.06 (−0.15, 0.27) | 0.29 (−0.72, 1.31) | 0.560 | 36,690\|70\|0 | 0.00095 | 0.19% |
| PDFF adjusted[a] (Fraction of sampled pixels) | 0.05 (−0.12, 0.22) | 0.24 (−0.58, 1.06) | 0.569 | 35,205\|69\|0 | 0.00098 | 0.20% |
| cT1 (time in milliseconds) | −0.23 (−0.45, −0.00) | −10.4 (−21.3, −0.00) | 0.047 | 36,690\|70\|0 | 0.00095 | 0.19% |
| cT1 adjusted[a] (time in milliseconds) | −0.26 (−0.47, −0.06) | −11.83 (−21.38, −2.73) | 0.012 | 35,205\|69\|0 | 0.00098 | 0.20% |
| T1 (time in milliseconds) | −0.33 (−0.56, −0.11) | −15.3 (−25.95, −5.10) | 0.0035 | 36,690\|70\|0 | 0.00095 | 0.19% |
| T1 adjusted[a] (time in milliseconds) | −0.36 (−0.57, −0.14) | −16.68 (−26.41, −6.49) | 0.00097 | 35,205\|69\|0 | 0.00098 | 0.20% |

[a]Adjusted for technical covariates including BMI, alcohol usage, and diabetes.

Abbreviations: PDFF=Proton density fat fraction (defined as the ratio of density of mobile protons from fat (triglycerides) and the total density of protons from mobile triglycerides and mobile water and reflects the concentration of fat within a tissue), ECF=extracellular fluid, T1=time constant for recovery of longitudinal magnetization. It's a relaxation time which measures how quickly the net magnetization recovers to its ground state. It can differ significantly based on the strength of the magnetic field and based on tissue composition. Furthermore, it increases with increased magnetic field, while it decreases with presence of fat and/or iron in the tissue, cT1=T1 corrected for the effects of liver iron content which result in T1 values being underestimated, UKB=UK biobank study population, AAF=frequency of pLOF alleles across pLOF variants in the gene, RR=count of individuals having no heterozygous or homozygous observations of pLOFs variants in the gene, RA=count of individuals with at least one heterozygous pLOF and no homozygotes pLOF variants in the gene, AA=count of individuals with at least one homozygous pLOF variants in the gene, CI=confidence interval, pLOF=predicted loss-of-function, SD=standard deviation.

Table 12 shows the association of INHBE pLOF variants with a range of liver imaging phenotypes in European ancestry individuals from the UK Biobank study population. The results show that INHBE pLOF variants are associated with lower levels of ECF and cT1 which are measures of liver inflammation, as defined by magnetic resonance imaging.

It was additionally investigated whether INHBE pLOF variants were associated with liver histopathology phenotypes in 3,565 bariatric surgery patients from the GHS cohort who underwent exome sequencing and a perioperative wedge biopsy of the liver. There were only three carriers for pLOF variants in INHBE in that set, but carrier status was associated with lower nonalcoholic fatty liver disease activity score (see, Table 13), a measure of the severity of liver disease at biopsy that sums steatosis, lobular inflammation and ballooning grades (Kleiner et al., Hepatology, 2005, 41, 1313-21).

TABLE 13

Association with lower nonalcoholic fatty liver disease activity score for rare pLOF variants in INHBE

| Outcome | Beta in SD of NAFLD activity score per allele (95% CI) | P-value | INHBE pLOF genotypes (Ref/Het/Hom) |
|---|---|---|---|
| NAFLD activity score | −1.05 (−1.98, −0.12) | 0.026 | 3,565\|3\|0 |

The association with NAFLD activity score (outcome) for rare pLOF variants in INHBE was reported. The association was estimated in 3,565 bariatric surgery patients from GHS.

Finally, it was found that a common variant near INHBE (12:57259799:A:C; rs57966846; AAF, 0.28) is associated with higher liver expression levels of INHBE mRNA (per-allele beta, 0.3 SDs of INHBE transcript abundance as quantified by RNASeq in over 2,000 participants to GHS who underwent a liver biopsy as part of bariatric surgery). It was also found that the 12:57259799:A:C variant is associated with higher BMI-adjusted WHR, triglycerides and risk of type 2 diabetes. The expression raising allele C was associated with higher BMI-adjusted WHR (p-value=1.5× $10^{-4}$), higher triglycerides (p-value=2.0× $10^{-11}$), higher T2D risk (p-value=0.03) (see, Table 14). This shows that genetically-determined overexpression of INHBE is associated with higher metabolic disease risk, while a loss of function is associated favorable metabolic profile and lower diabetes risk (as noted above from the pLOF variants associations).

TABLE 14

Association of an INHBE eQTL, 12:57259799:A:C, with various metabolic phenotypes in the UKB and GHS cohorts

| Genetic exposure | Outcome (Clinical Units) | AAF | Per allele effect (95% CI) in SD units or odds ratio | Per allele beta (95% CI) in Clinical Units | P-value | Genotype counts, RR\|RA\|AA genotypes |
|---|---|---|---|---|---|---|
| 12:57259799: A:C, Count of INHBE liver expression raising allele C | Triglycerides (mg/dL) | 0.285 | 0.01 SDs (0.009, 0.02) | 0.9 (0.9, 1.0) | $2.0 \times 10^{-11}$ | 274,658\|216,943\| 43,388 |
| | BMI-adj WHR (ratio units) | 0.285 | 0.008 SDs (0.004, 0.012) | 0.00064 (0.00032, 0.00080) | $1.5 \times 10^{-4}$ | 235,613\|187,407\| 37,740 |
| | T2D | 0.285 | $1.02^a$ ($1.00^a$, $1.04^a$) | — | 0.037 | T2D Controls: 255,408\|201,524\| 40,210 T2D Cases: 27,105\|21,053\|4,295 |

$^a$Estimates are in odds ratios.

Abbreviations: AAF=allele frequency of INHBE liver expression raising allele (i.e., alternate allele), CI=confidence interval, SD=standard deviation, RR=reference-reference allele, RA=reference-alternative allele, AA=alternative-alternative allele, mg/dL=milligrams per deciliter. Genotype counts display the number of individuals in the population studies having no copies of the INHBE liver expression raising allele (RR), having only one copy of the INHBE liver expression raising allele (RA), and having 2 copies of the INHBE liver expression raising allele (AA). Genotype counts are further stratified within individuals classified as T2D cases in the study population.

The association of 12:57259799:A:C with triglyceride levels, WHRadjBMI, and T2D risk was studied in all European ancestry participants from the UK Biobank and Geisinger Health studies. The results show that 12:57259799:A:C was significantly associated with higher triglyceride levels and higher BMI-adjusted WHR; in addition, there was an association with higher T2D risk.

Figure 7:
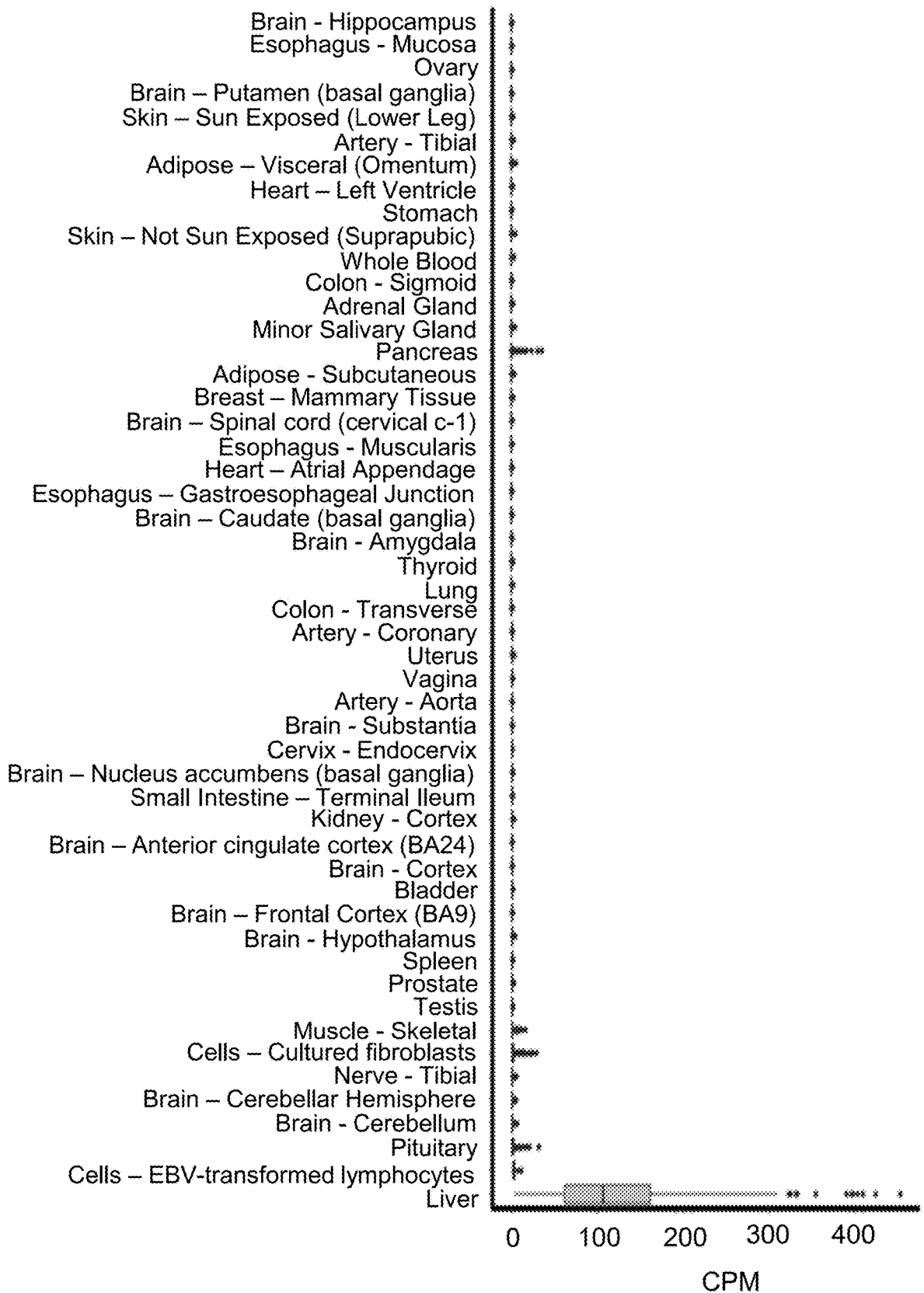
FIG. 7 shows INHBE expression patterns across tissues (left) and liver cell-types (right). The first panel shows, per tissue, the normalized mRNA expression values for INHBE in counts per million (CPM) using data from genotype tissue expression (GTEx) consortium (GTEx Portal 2021. Accessed 2021, June 1$^{st}$ via world wide web at "gtexportal.org/"). The second panel shows normalized cell-type specific expression levels within liver, in transcripts per million protein coding genes (pTPM), obtained from the human protein atlas (HPA) (Uhlen et al., Nat. Biotechnol. 2010, 28, 1248-50). Box plots depict the median (thick black vertical bar), the interquartile range, and minimum and maximum CPM values across individuals per tissue.
Figure 7:
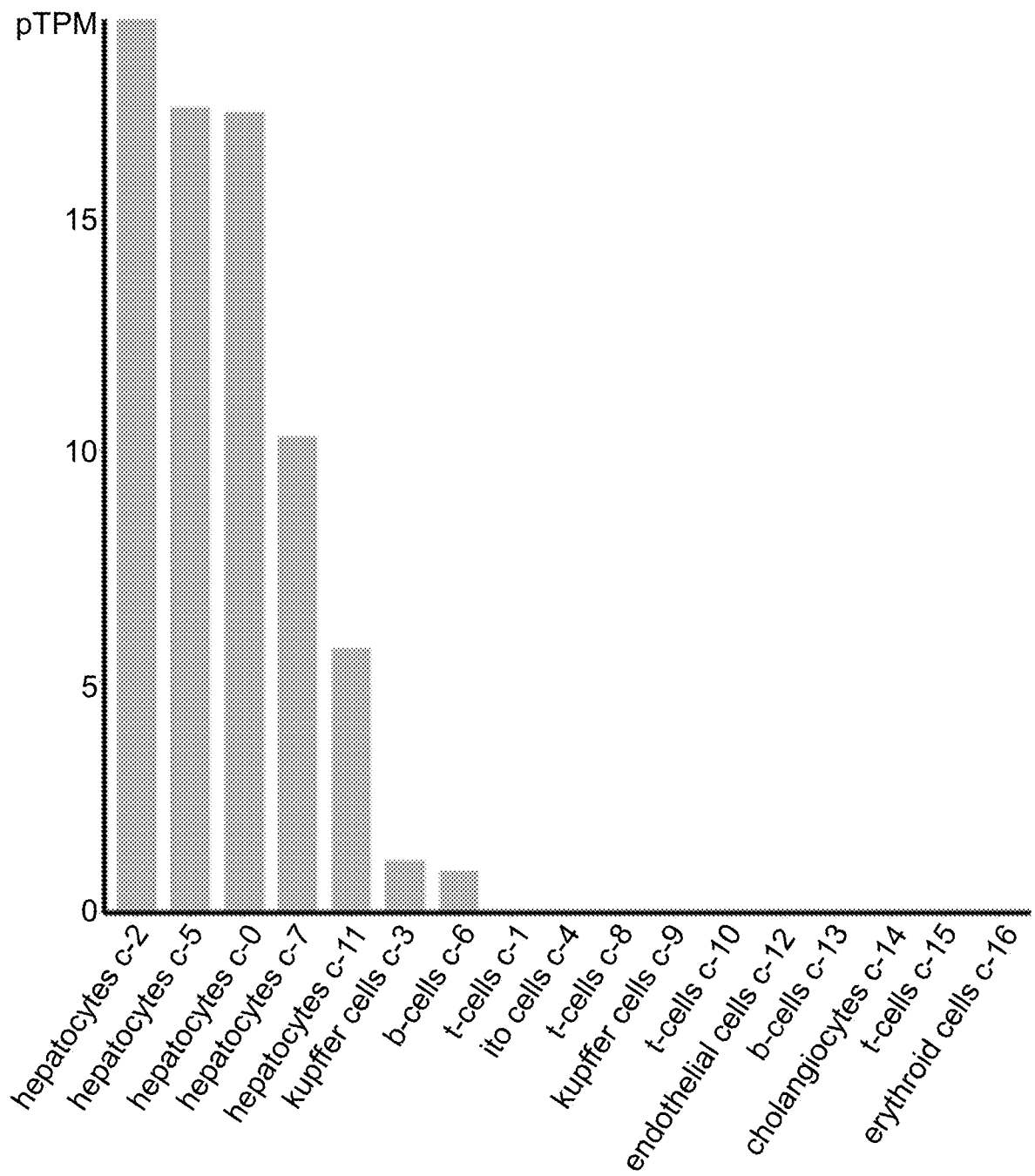
Figure 8:
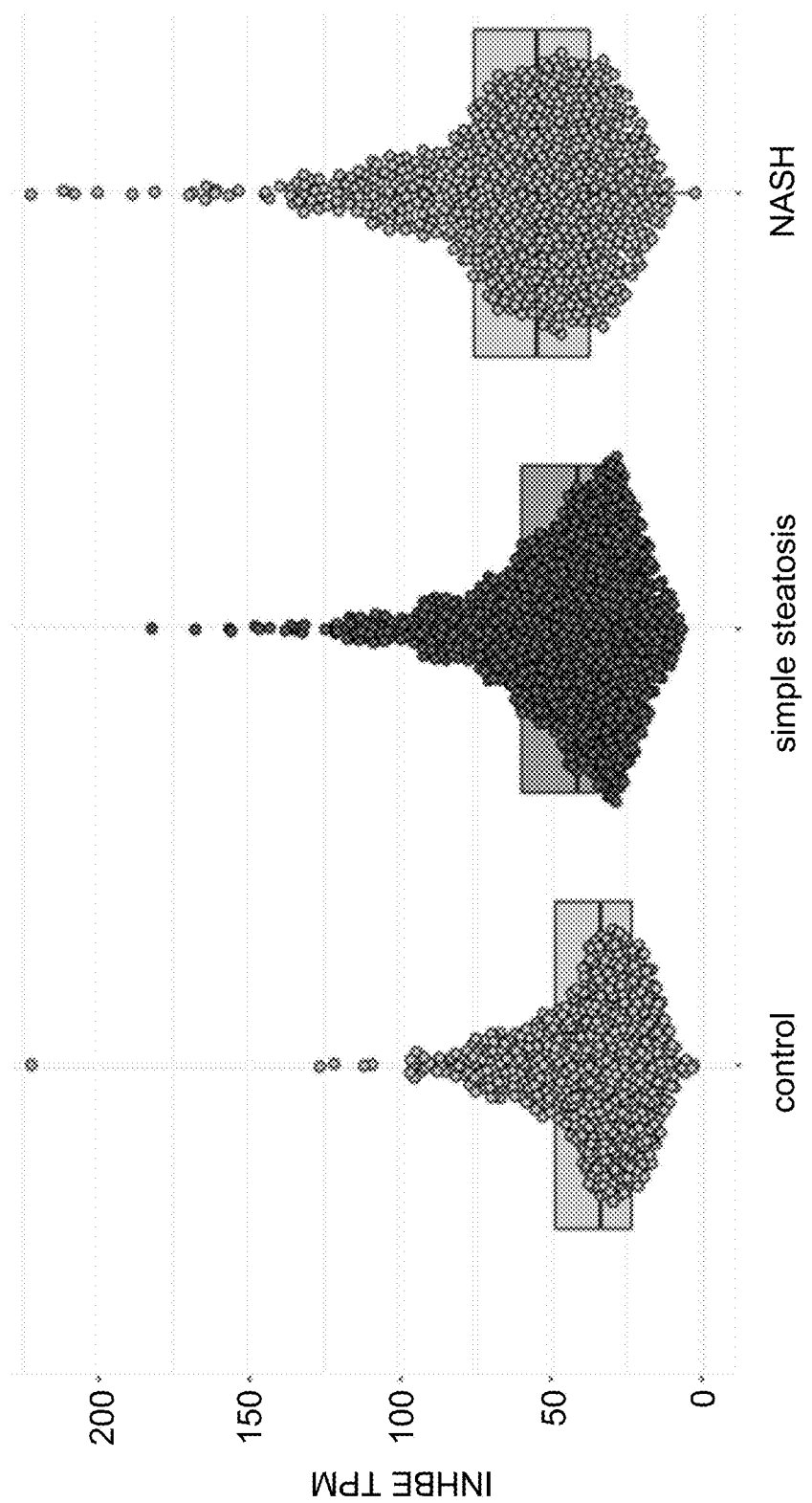
FIG. 8 shows liver mRNA expression of INHBE is upregulated in patients with steatosis and nonalcoholic steatohepatitis (NASH) compared to individuals with normal liver in bariatric surgery patients from GHS. In the top panel, the Figure shows liver mRNA expression levels of INHBE in transcripts per million (TPM; a normalization of RNA molecules for every 1 million molecules detected in a certain experiment) in patients with normal liver (control), steatosis of the liver (simple steatosis) and nonalcoholic steatohepatitis (NASH). In the bottom panel are statistics for comparisons between groups. The simple steatosis group showed higher expression of INHBE in the liver than the control group. The NASH group showed higher expression both when compared to the control and when compared to the simple steatosis groups. All differences in expression between groups were statistically significant.

Example 2: INHBE is Highly Expressed in Human Hepatocytes and its Expression was Upregulated in Patients with Steatosis and Nonalcoholic Steatohepatitis The mRNA expression of INHBE across tissues in humans from the Genotype Tissue Expression consortium (GTEx) was examined and it was found that INHBE is most highly expressed in liver among the GTEx tissues (see, FIG. 7). The mRNA expression of INHBE among cell types was also examined in data from the Human Protein Atlas (HPA) and it was found that INHBE was most highly expressed in hepatocytes (see, FIG. 7). The level of expression of INHBE in the liver of over 2,000 bariatric surgery patients in GHS who underwent liver RNASeq was also estimated. It was discovered that INHBE expression was upregulated in patients with steatosis of the liver compared to individuals with normal liver, in patients with nonalcoholic steatohepatitis compared to individuals with normal liver, and in patients with nonalcoholic steatohepatitis compared to patients with steatosis (see, FIG. 8).

Example 3: Associations with Visceral to Gluteofemoral Fat Ratio as Measured by MRI for INHBE Identified in the BMI-Adjusted WHR Discovery Analysis A subset of approximately 46,000 participants in UKB underwent two-point Dixon (Dixon, Radiology, 1984, 153, 189-194) MRI using Siemens MAGNETOM Aera 1.5T clinical MRI scanners (Littlejohns et al., Nat. Commun., 2020, 11, 2624), split into six different imaging series. This subset included 38,880 people with available exome sequencing. Stitching of the six different scan positions corrected for overlapping slices, partial scans, repeat scans, fat-water swaps, misalignment between imaging series, bias-field, artificially dark slices and local hotspots, similar to what has previously been performed (Basty et al., Image Processing and Quality Control for Abdominal Magnetic Resonance Imaging in the UK Biobank, 2020, ArXiv abs/2007.01251). A total of 52 subjects had their whole-body Dixon MRI manually annotated into six different classes of fat: upper body fat, abdominal fat, visceral fat, mediastinal fat, gluteofemoral fat and lower-leg fat. Special care was taken to tailor the training dataset to attempt to span the phenotypic diversity expected by specifically including training subjects that have genetic mutations that predispose them to abnormal fat and muscle phenotypes such as PPARG (Ludtke et al., J. Med. Genet., 2007, 44, e88), PLIN1 (Gandotra et al., N. Engl. J. Med., 2011, 364, 740-748), LMNA (Jeru et al., J. Med. Genet., 2017, 54, 413-416), LIPE (Zolotov et al., Am. J. Med. Genet., 2017, A 173, 190-194) and MC4R (Akbari et al., Science, 2021, 373). These annotations were then used to train a multi-class segmentation deep neural-net which employed a UNet (Weng et al., IEEE Access, 2021, 9, 16591-16603) architecture with a ResNet34 (He et al., in 2016 IEEE Conference on Computer Vision and Pattern Recognition (CVPR), 2016, 770-778) backbone, and a loss function of a sum of the Jaccard Index and categorical focal loss (Lin et al., IEEE Transactions on Pattern Analysis and Machine Intelligence, 2020, 42, 318-327). Fat volume phenotypes were calculated by summing the resulting segmentation maps from the neural net for each corresponding fat class. The visceral-to-gluteofemoral fat ratio was then calculated as the ratio of visceral to gluteofemoral fat volume for a given individual.

Rare coding variants in INHBE associated with BMI-adjusted WHR showed highly consistent associations with visceral-to-gluteofemoral fat ratio at MRI, a refined measure of fat distribution, in a subset of 38,880 people (i.e., ~6% of the discovery sample) who had undergone a whole-body MRI in UKB (see, Table 15). There was a nominally-significant association with lower MRI-defined visceral-to-gluteofemoral fat ratio for INHBE pLOF variants in the subset of UKB with MRI data (beta in SD units of fat ratio per allele, −0.24; 95% CI, −0.45 to −0.02; p=0.03; see, Table 15).

TABLE 15

| Beta (95% CI) per allele in SD units of visceral to gluteofemoral fat ratio from MRI | P | Genotype counts, RR\|RA\|AA genotypes | AAF, fraction of 1 |
|---|---|---|---|
| −0.238 (−0.453, −0.023) | 3.0E−02 | 38802\|78\|0 | 0.0010 |

Each gene-burden result in the table was analyzed in a model that accounted for the sex specific effects of age, body mass index, and height on visceral to gluteofemoral fat ratio. Abbreviations: pLOF, predicted loss of function; AAF, alternative allele frequency; CI, confidence intervals; SD, standard deviation; BMI, body mass index; p, P-value; RR, reference homozygote genotype; RA, reference-alternative genotype; AA, alternative homozygote genotype.

Example 4: INHBE Predicted Loss-of-Function Association with Increased Left Ventricular Ejection Fraction and Protection of Cardiomyopathy Cases in the present example were any study participant without heart disease. The results were based on meta-analyses of UKB, GHS, SINAI, UPENN-PMBB, MDCS, Indiana-Chalasani. Predicted loss-of-function in INHBE associated with increased left ventricular ejection fraction and protection of cardiomyopathy are shown in Table 16 (Burden of INHBE rare pLoF variants (M1.1)).

TABLE 16

| Outcome | Beta$_{SD}$ or OR [95% CI] | Clin. unit | P-value | Case allele count (RR\|RA\|AA) | Control allele count (RR\|RA\|AA) | AA carriers |
|---|---|---|---|---|---|---|
| 1 | 0.26 (0.04, 0.47) | 1.57% | 0.019 | 38,651\|80\|0 | — | 0.21% |
| 2 | 0.46 (0.23, 0.95) | — | 0.034 | 5,111\|2\|0 | 342,838\|650\|0 | 0.19% |

Outcome 1 is left ventricular ejection fraction*.
Outcome 2 is non-ischemic cardiomyopathy**.
*Left ventricular ejection fraction obtained by cardiac MRI in participants of the UK Biobank.
**Non-ischemic cardiomyopathy cases were defined as study participants with one or more of the following ICD10 codes: I420 (Dilated Cardiomyopathy), I425 (Other restrictive cardiomyopathy), I428 (Other noncompaction cardiomyopathies), I429 (primary cardiomyopathy\|unspecified), and absence of one or more of any ICD10 code indicative of myocardial infarction (I21\|I22\|I23\|I252\|I256) and hypertrophic cardiomyopathy (I421, I422).

Association of pLOF variants with lower blood pressure (see, Table 17; burden of INHBE rare pLOF variants—M1.1) is consistent with beneficial effect on hemodynamic traits.

TABLE 17

| Trait | Beta (95% CI) per allele in SD units | Effect in mmHg (95% CI) per allele | P-value | AAF, fraction of 1 | Genotype Counts (RR\|RA\|AA) |
|---|---|---|---|---|---|
| 1 | −0.06 (−0.11, −0.01) | −0.56 (−1.07, −0.05) | 0.03 | 0.00102 | 599,306\|1,224\|0 |
| 2 | −0.05 (−0.10, 0.00) | −0.84 (−1.72, 0.04) | 0.0614 | 0.00102 | 599,608\|1,224\|0 |

Trait 1 is diastolic blood pressure (treatment corrected).
Trait 2 is systolic blood pressure (treatment corrected).

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety and for all purposes.

SEQUENCE LISTING (4937 sequences)

SEQ ID NO: 1 - DNA, 2719 bp, homo sapien
agtagccagacatgagctgtgagggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacaggtgggtgagggagagagcaacaggcaaagagcagacagggaaagggaggcagaaggggagcctggcaggagcagcagagggagtggggtgtggcaggagaaggaggagctggggcagggactggttgcagaggacacaaagcagtctctacttttctagaggtaggttcgagggagagcagtgggcagggcttggggagtctcagaggagagcttcatctctactcacattttctttcccttttctgtctttcgggcagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggagacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccagaggccgtgtgacatgtgattacatcatctttctgacatcattgttaatggaatgtgtgcttgta

SEQ ID NO: 2 - RNA, 1616 nt, homo sapien
augagcugugagggucaagcacagcuauccaucagaugaucuacuuucagccuuccugagucccagacaauagaagacagguggcuguacccuuggccaaggguagguguggcaguggugucugcugucacugugcccucauuggcccccagcaaucagacucaacagacggagcaacugccauccgaggcuccugaaccagggccauucaccaggagcaugcggcucccugauguccagcucuggcuggugcugcugugggcacuggugcgagcacaggggacagggucugugugucccuccugugggggcuccaaacuggcaccccaagcagaacgagcucuggugcuggagcuagccaagcagcaaauccuggauggguugcaccugaccagucgucccagaauaacucauccuccaccccaggcagcgcugaccagagcccuccggagacuacagccagggaguguggcuccagggaauggggaggaggucaucagcuuugcuacugucacagacuccacuucagccuacagcucccugcucacuuuucaccuguccacuccucggucccaccaccuguaccaugcccgccuguggcugcacgugcuccccacccuuccuggcacucuuugcuugaggaucuuccgauggggaccaaggaggaggcgccaagggucccgcacucuccuggcugagcaccacaucaccaaccugggcuggcauaccuuaacucugcccucuaguggcuugaggggugagaagucugguguccugaaacugcaacuagacugcagaccccuagaaggcaacagcacaguuacuggacaaccgaggcggcucuuggacacagcaggacaccagcagcccuuccuagagcuuaagauccgagccaaugagccuggagcaggccgggccaggaggaggacccccaccugugagccugcgacccccuuauguugcaggcgagaccauuacguagacuuccaggaacugggauggcgggacuggauacugcagcccgagggguaccagcugaauuacugcagugggcagugcccuccccaccuggcuggcagcccaggcauugcugccucuuuccauucugccgucuucagccuccucaaagccaacaauccuuggccugccaguaccuccuguugugucccuacugcccgaaggccccucucucuccucuaccuggaucauaauggcaauguggucaagacggaugugccagauauggugguggaggccuguggcugcagcuagcaagaggaccuggggcuuuggagugaagagaccaagaugaaguuucccaggcacagggcaucugugacuggaggcaucagauuccugauccacaccccaacccaacaaccaccuggcaauaugacucacuugaccccuaugggacccaaaugggcacuuucuugucugagacucuggcuuauuccagguuggcugauguguugggagauggguaaagcguuucuucuaaaggggucuacccagaaagcaugauuuccugcccuaaguccugugagaagaugucagggacuagggagggagggagggaaggcagagaaaaauuacuuagccucucccaagaugag

SEQ ID NO: 3 - RNA, 2445 nt, homo sapien
agcugugagggucaagcacagcuauccaucagaugaucuacuuucagccuuccugagucccagacaauagaagacagguggcuguacccuuggccaaggguagguguggcaguggugucugcugucacugugcccucauuggcccccagcaaucagacucaacagacggagcaacugccauccgaggcuccugaaccagggccauucaccaggagcaugcggcucccugauguccagcucuggcuggugcugcugugggcacuggugcgagcacaggggacagggucugugugucccuccugugggggcuccaaacuggcaccccaagcagaacgagcucuggugcuggagcuagccaagcagcaaauccuggauggguugcaccugaccagucgucccagaauaacucauccuccaccccaggcagcgcugaccagagcccuccggagacuacagccagggaguguggcuccagggaauggggaggaggucaucagcuuugcuacugucacagacuccacuucagccuacagcucccugcucacuuuucaccuguccacuccucggucccaccaccuguaccaugcccgccuguggcugcacgugcuccccacccuuccuggcacucuuugcuugaggaucuuccgauggggaccaaggaggaggcgccaagggucccgcacucuccuggcugagcaccacaucaccaaccugggcuggcauaccuuaacucugcccucuaguggcuugaggggugagaagucugguguccugaaacugcaacuagacugcagaccccuagaaggcaacagcacaguuacuggacaaccgaggcggcucuuggacacagcaggacaccagcagcccuuccuagagcuuaagauccgagccaaugagccuggagcaggccgggccaggaggaggacccccaccugugagccugcgacccccuuauguugcaggcgagaccauuacguagacuuccaggaacugggauggcgggacuggauacugcagcccgagggguaccagcugaauuacugcagugggcagugcccuccccaccuggcuggcagcccaggcauugcugccucuuuccauucugccgucuucagccuccucaaagccaacaauccuuggccugccaguaccuccuguugugucccuacugcccgaaggccccucucucuccucuaccuggaucauaauggcaauguggucaagacggaugugccagauauggugguggaggccuguggcugcagcuagcaagaggaccuggggcuuuggagugaagagaccaagaugaaguuucccaggcacagggcaucugugacuggaggcaucagauuccugauccacaccccaacccaacaaccaccuggcaauaugacucacuugaccccuaugggacccaaaugggcacuuucuugucugagacucuggcuuauuccagguuggcugauguguugggagauggguaaagcguuucuucuaaaggggucuacccagaaagcaugauuuccugcccuaaguccugugagaagaugucagggacuagggagggagggagggaaggcagagaaaaauuacuuagccucucccaagaugagaaaguccucaagugaggggaggaggaagcagauagaugguccagcaggcuugaagcaggguaagcaggcuggcccaggguaagggcuguugagguaccuuaagggaaggucaagagggagaugggcaaggcgcugagggaggaugcuuaggggacccccagaaacaggagucaggaaaaugaggcacuaagccuaagaaguucccugguuuuucccaggggacaggacccacugggagacaagcauuuauacuuucuuucuucuuuuuuauuuuuuugagaucgagucucgcucugucaccaggcuggagugcagugacacgaucuuggcucacugcaaccuccgucuccuggguucaagugauucuucugccucagccucccgagcagcugggauuacaggcgcccacuaauuuuuguauucuuaguagaaacgagguuucaacauguuggccaggauggucucaaucucuugaccucuugauccacccgacuuggccucccgaagugaugagauuauaggcgugagccaccgcgccuggcuuauacuuucuuaauaaaaaggagaaagaaaaucaacaaaugugagucauaaagaaggguuagggugaugguccagagcaacaguucuucaaguguacucuguaggcuucugggaggucccuuuucagggguguccacaaagucaaagcuauuuucauaauaauacuaacauguuauuugccuuuugaauucucauuaucuuaaaauuguauuguggaguuuuccagaggccgugugacaugugauuacaucaucuuucugacaucauuguuaaaaaaaaaaaaaaaaaa

SEQ ID NO: 4 - RNA, 2459 nt, homo sapien
gggucaagcacagcuauccaucagaugaucuacuuucagccuuccugagucccagacaauagaagacagguggcuguacccuuggccaaggguagguguggcaguggugucugcugucacugugcccucauuggcccccagcaaucagacucaacagacggagcaacugccauccgaggcuccugaaccagggccauucaccaggagcaugcggcucccugauguccagcucuggcuggugcugcugugggcacuggugcgagcacaggggacagggucugugugucccuccugugggggcuccaaacuggcaccccaagcagaacgagcucuggugcuggagcuagccaagcagcaaauccuggauggguugcaccugaccagucgucccagaauaacucauccuccaccccaggcagcgcugaccagagcccuccggagacuacagccagggaguguggcuccagggaauggggaggaggucaucagcuuugcuacugucacagacuccacuucagccuacagcucccugcucacuuuucaccuguccacuccucggucccaccaccuguaccaugcccgccuguggcugcacgugcuccccacccuuccuggcacucuuugcuugaggaucuuccgauggggaccaaggaggaggcgccaagggucccgcacucuccuggcugagcaccacaucaccaaccugggcuggcauaccuuaacucugcccucuaguggcuugaggggugagaagucugguguccugaaacugcaacuagacugcagaccccuagaaggcaacagcacaguuacuggacaaccgaggcggcucuuggacacagcaggacaccagcagcccuuccuagagcuuaagauccgagccaaugagccuggagcaggccgggccaggaggaggacccccaccugugagccugcgacccccuuauguugcaggcgagaccauuacguagacuuccaggaacugggauggcgggacuggauacugcagcccgagggguaccagcugaauuacugcagugggcagugcccuccccaccuggcuggcagcccaggcauugcugccucuuuccauucugccgucuucagccuccucaaagccaacaauccuuggccugccaguaccuccuguugugucccuacugcccgaaggccccucucucuccucuaccuggaucauaauggcaauguggucaagacggaugugccagauauggugguggaggccuguggcugcagcuagcaagcaggaccuggggcuuuggagugaagagaccaagaugaaguuucccaggcacagggcaucugugacuggaggcaucagauuccugauccacaccccaacccaacaaccaccuggcaauaugacucacuugaccccuaugggacccaaaugggcacuuucuugucugagacucuggcuuauuccagguuggcugauguguugggagauggguaaagcguuucuucuaaaggggucuacucagaaagcaugauuuccugcccuaaguccugugagaagaugucagggacuagggagggagggagggaaggcagagaaaaauuacuuagccucucccaagaugagaaaguccucaagugaggggaggaggaagcagauagaugguccagcaggcuugaagcaggguaagcaggcuggcccaggguaagggcuguugagguaccuuaagggaaggucaagagggagaugggcaaggcgcugagggaggaugcuuaggggacccccagaaacaggagucaggaaaaugaggcacuaagccuaagaaguucccugguuuuucccaggggacaggacccacugggcgacaagcauuuauacuuucuuucuucuuuuuuauuuuuuugagaucgagucucgcucugucaccaggcuggagugcagugacacgaucuuggcucacugcaaccuccgucuccuggguucaagugauucuucugccucagccucccgagcagcugggauuacaggcgcccacuaauuuuuguauucuuaguagaaacgagguuucaacauguuggccaggauggucucaaucucuugaccucuugauccacccgacuuggccucccgaagugaugagauuauaggcgugagccaccgcgccuggcuuauacuuucuuaauaaaaaggagaaagaaaaucaacaaaugugagucauaaagaaggguuagggugaugguccagagcaacaguucuucaaguguacucuguaggcuucugggaggucccuuuucagggguguccacaaagucaaagcuauuuucauaauaauacuaacauguuauuugccuuuugaauucucauuaucuuaaaauuguauuguggaguuuuccaaaggccgugugacaugugauuacaucaucuuucugacaucaaaaaaaaaaaaaaaaaaaaaaaaaaaaaaaaaaaaaaaaaaaaa

SEQ ID NO: 5 - DNA, 1616 bp, homo sapien
atgagctgtgagggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgag

SEQ ID NO: 6 - DNA, 2445 bp, homo sapien
agctgtgagggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggagacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccagaggccgtgtgacatgtgattacatcatctttctgacatcattgttaaaaaaaaaaaaaaaaaa

SEQ ID NO: 7 - DNA, 2459 bp, homo sapien
gggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagcaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctactcagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggcgacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccaaaggccgtgtgacatgtgattacatcatctttctgacatcaaaaaaaaaaaaaaaaaaaaaaaaaaaaaaaaaaaaaaaaaaaaa

SEQ ID NO: 8 - protein, 350 aa, homo sapien
MRLPDVQLWLVLLWALVRAQGTGSVCPSCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 9 - DNA, 20 bp, artificial sequence
  gRNA Recognition Sequence
cgtctgttgagtctgattgc

SEQ ID NO: 10 - DNA, 20 bp, artificial sequence
  gRNA Recognition Sequence
gacggagcaactgccatccg

SEQ ID NO: 11 - DNA, 20 bp, artificial sequence
  gRNA Recognition Sequence
atcagggagccgcatgctcc

SEQ ID NO: 12 - DNA, 20 bp, artificial sequence
  gRNA Recognition Sequence
ctgaaccagggccattcacc

SEQ ID NO: 13 - DNA, 20 bp, artificial sequence
  gRNA Recognition Sequence
cctggttcaggagcctcgga

SEQ ID NO: 14 - DNA, 20 bp, artificial sequence
  gRNA Recognition Sequence
catccgaggctcctgaacca

SEQ ID NO: 15 - DNA, 20 bp, artificial sequence
  gRNA Recognition Sequence
ccatccgaggctcctgaacc

SEQ ID NO: 16 - DNA, 20 bp, artificial sequence
  gRNA Recognition Sequence
gccacctgtcttctattgtc

SEQ ID NO: 17 - DNA, 20 bp, artificial sequence
  gRNA Recognition Sequence
agccgcatgctcctggtgaa

SEQ ID NO: 18 - DNA, 20 bp, artificial sequence
  gRNA Recognition Sequence
gtctgttgagtctgattgct

SEQ ID NO: 19 - DNA, 20 bp, artificial sequence
  gRNA Recognition Sequence
aagacaggtggctgtaccct

SEQ ID NO: 20 - DNA, 20 bp, artificial sequence
  gRNA Recognition Sequence
ctgattgctgggggccaatg

SEQ ID NO: 21 - DNA, 20 bp, artificial sequence
  gRNA Recognition Sequence
tgattgctgggggccaatga

SEQ ID NO: 22 - DNA, 20 bp, artificial sequence
  gRNA Recognition Sequence
ccacctgtcttctattgtct

SEQ ID NO: 23 - DNA, 20 bp, artificial sequence
  gRNA Recognition Sequence
atgctcctggtgaatggccc

SEQ ID NO: 24 - DNA, 20 bp, artificial sequence
  gRNA Recognition Sequence
ctgttgagtctgattgctgg

SEQ ID NO: 25 - DNA, 20 bp, artificial sequence
  gRNA Recognition Sequence
ctggtgaatggccctggttc

SEQ ID NO: 26 - DNA, 20 bp, artificial sequence
  gRNA Recognition Sequence
accactgccacacctaccct

SEQ ID NO: 27 - DNA, 20 bp, artificial sequence
  gRNA Recognition Sequence
tctgttgagtctgattgctg

SEQ ID NO: 28 - DNA, 23 bp, artificial sequence
  original exon 2
agactccacttcagcctacagct

SEQ ID NO: 29 - DNA, 23 bp, artificial sequence
  predicted exon 2
acactccacttcagcctacagct

SEQ ID NO: 30 - RNA, 20 nt, Artificial Sequence
  Antisense Sequence
acagcucaugucuggcuacu

SEQ ID NO: 31 - RNA, 20 nt, Artificial Sequence
  Antisense Sequence
ugacccucacagcucauguc

SEQ ID NO: 32 - RNA, 20 nt, Artificial Sequence
  Antisense Sequence
uugacccucacagcucaugu

SEQ ID NO: 33 - RNA, 20 nt, Artificial Sequence
  Antisense Sequence
ugcuugacccucacagcuca

SEQ ID NO: 34 - RNA, 20 nt, Artificial Sequence
  Antisense Sequence
gugcuugacccucacagcuc

SEQ ID NO: 35 - RNA, 20 nt, Artificial Sequence
  Antisense Sequence
uagcugugcuugacccucac

SEQ ID NO: 36 - RNA, 20 nt, Artificial Sequence
  Antisense Sequence
auagcugugcuugacccuca

SEQ ID NO: 37 - RNA, 20 nt, Artificial Sequence
  Antisense Sequence
gauagcugugcuugacccuc

SEQ ID NO: 38 - RNA, 20 nt, Artificial Sequence
  Antisense Sequence
ggauagcugugcuugacccu

SEQ ID NO: 39 - RNA, 20 nt, Artificial Sequence
  Antisense Sequence
uggauagcugugcuugaccc

SEQ ID NO: 40 - RNA, 20 nt, Artificial Sequence
  Antisense Sequence
auggauagcugugcuugacc

SEQ ID NO: 41 - RNA, 20 nt, Artificial Sequence
  Antisense Sequence
gauggauagcugugcuugac

SEQ ID NO: 42 - RNA, 20 nt, Artificial Sequence
  Antisense Sequence
ugauggauagcugugcuuga

SEQ ID NO: 43 - RNA, 20 nt, Artificial Sequence
  Antisense Sequence
aucugauggauagcugugcu

SEQ ID NO: 44 - RNA, 20 nt, Artificial Sequence
  Antisense Sequence
caucugauggauagcugugc

SEQ ID NO: 45 - RNA, 20 nt, Artificial Sequence
  Antisense Sequence
aucaucugauggauagcugu

SEQ ID NO: 46 - RNA, 20 nt, Artificial Sequence
  Antisense Sequence
gaucaucugauggauagcug

SEQ ID NO: 47 - RNA, 20 nt, Artificial Sequence
  Antisense Sequence
agaucaucugauggauagcu

SEQ ID NO: 48 - RNA, 20 nt, Artificial Sequence
  Antisense Sequence
uagaucaucugauggauagc

SEQ ID NO: 49 - RNA, 20 nt, Artificial Sequence
  Antisense Sequence
guagaucaucugauggauag

SEQ ID NO: 50 - RNA, 20 nt, Artificial Sequence
  Antisense Sequence
gaaaguagaucaucugaugg

SEQ ID NO: 51 - RNA, 20 nt, Artificial Sequence
  Antisense Sequence
gcugaaaguagaucaucuga

SEQ ID NO: 52 - RNA, 20 nt, Artificial Sequence
  Antisense Sequence
aggcugaaaguagaucaucu

SEQ ID NO: 53 - RNA, 20 nt, Artificial Sequence
  Antisense Sequence
aaggcugaaaguagaucauc

SEQ ID NO: 54 - RNA, 20 nt, Artificial Sequence
  Antisense Sequence
gaaggcugaaaguagaucau

SEQ ID NO: 55 - RNA, 20 nt, Artificial Sequence
  Antisense Sequence
ggaaggcugaaaguagauca

SEQ ID NO: 56 - RNA, 20 nt, Artificial Sequence
  Antisense Sequence
aggaaggcugaaaguagauc

SEQ ID NO: 57 - RNA, 20 nt, Artificial Sequence
  Antisense Sequence
gucugggacucaggaaggcu

SEQ ID NO: 58 - RNA, 20 nt, Artificial Sequence
  Antisense Sequence
uauugucugggacucaggaa

SEQ ID NO: 59 - RNA, 20 nt, Artificial Sequence
  Antisense Sequence
cuauugucugggacucagga

SEQ ID NO: 60 - RNA, 20 nt, Artificial Sequence
  Antisense Sequence
ucuauugucugggacucagg

SEQ ID NO: 61 - RNA, 20 nt, Artificial Sequence
  Antisense Sequence
cuucuauugucugggacuca

SEQ ID NO: 62 - RNA, 20 nt, Artificial Sequence
  Antisense Sequence
ucuucuauugucugggacuc

SEQ ID NO: 63 - RNA, 20 nt, Artificial Sequence
  Antisense Sequence
caccugucuucuauugucug

SEQ ID NO: 64 - RNA, 20 nt, Artificial Sequence
  Antisense Sequence
ccaccugucuucuauugucu

SEQ ID NO: 65 - RNA, 20 nt, Artificial Sequence
  Antisense Sequence
gccaccugucuucuauuguc

SEQ ID NO: 66 - RNA, 20 nt, Artificial Sequence
  Antisense Sequence
agccaccugucuucuauugu

SEQ ID NO: 67 - RNA, 20 nt, Artificial Sequence
  Antisense Sequence
augagggcacagugacagca

SEQ ID NO: 68 - RNA, 20 nt, Artificial Sequence
  Antisense Sequence
caaugagggcacagugacag

SEQ ID NO: 69 - RNA, 20 nt, Artificial Sequence
  Antisense Sequence
ccaaugagggcacagugaca

SEQ ID NO: 70 - RNA, 20 nt, Artificial Sequence
  Antisense Sequence
cgucuguugagucugauugc

SEQ ID NO: 71 - RNA, 20 nt, Artificial Sequence
  Antisense Sequence
ccgucuguugagucugauug

SEQ ID NO: 72 - RNA, 20 nt, Artificial Sequence
  Antisense Sequence
uccgucuguugagucugauu

SEQ ID NO: 73 - RNA, 20 nt, Artificial Sequence
  Antisense Sequence
cuccgucuguugagucugau

SEQ ID NO: 74 - RNA, 20 nt, Artificial Sequence
  Antisense Sequence
gcuccgucuguugagucuga

SEQ ID NO: 75 - RNA, 20 nt, Artificial Sequence
  Antisense Sequence
ugcuccgucuguugagucug

SEQ ID NO: 76 - RNA, 20 nt, Artificial Sequence
  Antisense Sequence
uugcuccgucuguugagucu

SEQ ID NO: 77 - RNA, 20 nt, Artificial Sequence
  Antisense Sequence
aguugcuccgucuguugagu

SEQ ID NO: 78 - RNA, 20 nt, Artificial Sequence
  Antisense Sequence
gcaguugcuccgucuguuga

SEQ ID NO: 79 - RNA, 20 nt, Artificial Sequence
  Antisense Sequence
ggcaguugcuccgucuguug

SEQ ID NO: 80 - RNA, 20 nt, Artificial Sequence
  Antisense Sequence
gauggcaguugcuccgucug

SEQ ID NO: 81 - RNA, 20 nt, Artificial Sequence
  Antisense Sequence
ggauggcaguugcuccgucu

SEQ ID NO: 82 - RNA, 20 nt, Artificial Sequence
  Antisense Sequence
agccucggauggcaguugcu

SEQ ID NO: 83 - RNA, 20 nt, Artificial Sequence
  Antisense Sequence
aggagccucggauggcaguu

SEQ ID NO: 84 - RNA, 20 nt, Artificial Sequence
  Antisense Sequence
uucaggagccucggauggca

SEQ ID NO: 85 - RNA, 20 nt, Artificial Sequence
  Antisense Sequence
ugguucaggagccucggaug

SEQ ID NO: 86 - RNA, 20 nt, Artificial Sequence
  Antisense Sequence
cugguucaggagccucggau

SEQ ID NO: 87 - RNA, 20 nt, Artificial Sequence
  Antisense Sequence
cuggugaauggcccugguuc

SEQ ID NO: 88 - RNA, 20 nt, Artificial Sequence
  Antisense Sequence
ccuggugaauggcccugguu

SEQ ID NO: 89 - RNA, 20 nt, Artificial Sequence
  Antisense Sequence
uccuggugaauggcccuggu

SEQ ID NO: 90 - RNA, 20 nt, Artificial Sequence
  Antisense Sequence
uggacaucagggagccgcau

SEQ ID NO: 91 - RNA, 20 nt, Artificial Sequence
  Antisense Sequence
aggauuugcugcuuggcuag

SEQ ID NO: 92 - RNA, 20 nt, Artificial Sequence
  Antisense Sequence
caggauuugcugcuuggcua

SEQ ID NO: 93 - RNA, 20 nt, Artificial Sequence
  Antisense Sequence
uccaggauuugcugcuuggc

SEQ ID NO: 94 - RNA, 20 nt, Artificial Sequence
  Antisense Sequence
acccauccaggauuugcugc

SEQ ID NO: 95 - RNA, 20 nt, Artificial Sequence
  Antisense Sequence
aacccauccaggauuugcug

SEQ ID NO: 96 - RNA, 20 nt, Artificial Sequence
  Antisense Sequence
caacccauccaggauuugcu

SEQ ID NO: 97 - RNA, 20 nt, Artificial Sequence
  Antisense Sequence
ugcaacccauccaggauuug

SEQ ID NO: 98 - RNA, 20 nt, Artificial Sequence
  Antisense Sequence
gugcaacccauccaggauuu

SEQ ID NO: 99 - RNA, 20 nt, Artificial Sequence
  Antisense Sequence
ggugcaacccauccaggauu

SEQ ID NO: 100 - RNA, 20 nt, Artificial Sequence
  Antisense Sequence
aggugcaacccauccaggau

SEQ ID NO: 101 - RNA, 20 nt, Artificial Sequence
  Antisense Sequence
caggugcaacccauccagga

SEQ ID NO: 102 - RNA, 20 nt, Artificial Sequence
  Antisense Sequence
ucaggugcaacccauccagg

SEQ ID NO: 103 - RNA, 20 nt, Artificial Sequence
  Antisense Sequence
gucaggugcaacccauccag

SEQ ID NO: 104 - RNA, 20 nt, Artificial Sequence
  Antisense Sequence
ggucaggugcaacccaucca

SEQ ID NO: 105 - RNA, 20 nt, Artificial Sequence
  Antisense Sequence
uggucaggugcaacccaucc

SEQ ID NO: 106 - RNA, 20 nt, Artificial Sequence
  Antisense Sequence
cuggucaggugcaacccauc

SEQ ID NO: 107 - RNA, 20 nt, Artificial Sequence
  Antisense Sequence
acuggucaggugcaacccau

SEQ ID NO: 108 - RNA, 20 nt, Artificial Sequence
  Antisense Sequence
gacuggucaggugcaaccca

SEQ ID NO: 109 - RNA, 20 nt, Artificial Sequence
  Antisense Sequence
acgacuggucaggugcaacc

SEQ ID NO: 110 - RNA, 20 nt, Artificial Sequence
  Antisense Sequence
gacgacuggucaggugcaac

SEQ ID NO: 111 - RNA, 20 nt, Artificial Sequence
  Antisense Sequence
ggacgacuggucaggugcaa

SEQ ID NO: 112 - RNA, 20 nt, Artificial Sequence
  Antisense Sequence
ucugggacgacuggucaggu

SEQ ID NO: 113 - RNA, 20 nt, Artificial Sequence
  Antisense Sequence
uucugggacgacuggucagg

SEQ ID NO: 114 - RNA, 20 nt, Artificial Sequence
  Antisense Sequence
auucugggacgacuggucag

SEQ ID NO: 115 - RNA, 20 nt, Artificial Sequence
  Antisense Sequence
uauucugggacgacugguca

SEQ ID NO: 116 - RNA, 20 nt, Artificial Sequence
  Antisense Sequence
uuauucugggacgacugguc

SEQ ID NO: 117 - RNA, 20 nt, Artificial Sequence
  Antisense Sequence
guuauucugggacgacuggu

SEQ ID NO: 118 - RNA, 20 nt, Artificial Sequence
  Antisense Sequence
aguuauucugggacgacugg

SEQ ID NO: 119 - RNA, 20 nt, Artificial Sequence
  Antisense Sequence
gaguuauucugggacgacug

SEQ ID NO: 120 - RNA, 20 nt, Artificial Sequence
  Antisense Sequence
ugaguuauucugggacgacu

SEQ ID NO: 121 - RNA, 20 nt, Artificial Sequence
  Antisense Sequence
augaguuauucugggacgac

SEQ ID NO: 122 - RNA, 20 nt, Artificial Sequence
  Antisense Sequence
gaugaguuauucugggacga

SEQ ID NO: 123 - RNA, 20 nt, Artificial Sequence
  Antisense Sequence
ggaugaguuauucugggacg

SEQ ID NO: 124 - RNA, 20 nt, Artificial Sequence
  Antisense Sequence
uggaggaugaguuauucugg

SEQ ID NO: 125 - RNA, 20 nt, Artificial Sequence
  Antisense Sequence
guggaggaugaguuauucug

SEQ ID NO: 126 - RNA, 20 nt, Artificial Sequence
  Antisense Sequence
gguggaggaugaguuauucu

SEQ ID NO: 127 - RNA, 20 nt, Artificial Sequence
  Antisense Sequence
ggguggaggaugaguuauuc

SEQ ID NO: 128 - RNA, 20 nt, Artificial Sequence
  Antisense Sequence
aaagcugaugaccuccuccc

SEQ ID NO: 129 - RNA, 20 nt, Artificial Sequence
  Antisense Sequence
caaagcugaugaccuccucc

SEQ ID NO: 130 - RNA, 20 nt, Artificial Sequence
  Antisense Sequence
agcaaagcugaugaccuccu

SEQ ID NO: 131 - RNA, 20 nt, Artificial Sequence
  Antisense Sequence
uagcaaagcugaugaccucc

SEQ ID NO: 132 - RNA, 20 nt, Artificial Sequence
  Antisense Sequence
guagcaaagcugaugaccuc

SEQ ID NO: 133 - RNA, 20 nt, Artificial Sequence
  Antisense Sequence
aguagcaaagcugaugaccu

SEQ ID NO: 134 - RNA, 20 nt, Artificial Sequence
  Antisense Sequence
acaguagcaaagcugaugac

SEQ ID NO: 135 - RNA, 20 nt, Artificial Sequence
  Antisense Sequence
ugacaguagcaaagcugaug

SEQ ID NO: 136 - RNA, 20 nt, Artificial Sequence
  Antisense Sequence
gugacaguagcaaagcugau

SEQ ID NO: 137 - RNA, 20 nt, Artificial Sequence
  Antisense Sequence
gucugugacaguagcaaagc

SEQ ID NO: 138 - RNA, 20 nt, Artificial Sequence
  Antisense Sequence
agucugugacaguagcaaag

SEQ ID NO: 139 - RNA, 20 nt, Artificial Sequence
  Antisense Sequence
gagucugugacaguagcaaa

SEQ ID NO: 140 - RNA, 20 nt, Artificial Sequence
  Antisense Sequence
uggagucugugacaguagca

SEQ ID NO: 141 - RNA, 20 nt, Artificial Sequence
  Antisense Sequence
guggagucugugacaguagc

SEQ ID NO: 142 - RNA, 20 nt, Artificial Sequence
  Antisense Sequence
aguggagucugugacaguag

SEQ ID NO: 143 - RNA, 20 nt, Artificial Sequence
  Antisense Sequence
aaguggagucugugacagua

SEQ ID NO: 144 - RNA, 20 nt, Artificial Sequence
  Antisense Sequence
ugaaguggagucugugacag

SEQ ID NO: 145 - RNA, 20 nt, Artificial Sequence
  Antisense Sequence
cugaaguggagucugugaca

SEQ ID NO: 146 - RNA, 20 nt, Artificial Sequence
  Antisense Sequence
gcugaaguggagucugugac

SEQ ID NO: 147 - RNA, 20 nt, Artificial Sequence
  Antisense Sequence
ggcugaaguggagucuguga

SEQ ID NO: 148 - RNA, 20 nt, Artificial Sequence
  Antisense Sequence
aggcugaaguggagucugug

SEQ ID NO: 149 - RNA, 20 nt, Artificial Sequence
  Antisense Sequence
uaggcugaaguggagucugu

SEQ ID NO: 150 - RNA, 20 nt, Artificial Sequence
  Antisense Sequence
guaggcugaaguggagucug

SEQ ID NO: 151 - RNA, 20 nt, Artificial Sequence
  Antisense Sequence
gcuguaggcugaaguggagu

SEQ ID NO: 152 - RNA, 20 nt, Artificial Sequence
  Antisense Sequence
agcuguaggcugaaguggag

SEQ ID NO: 153 - RNA, 20 nt, Artificial Sequence
  Antisense Sequence
gagcuguaggcugaagugga

SEQ ID NO: 154 - RNA, 20 nt, Artificial Sequence
  Antisense Sequence
gggagcuguaggcugaagug

SEQ ID NO: 155 - RNA, 20 nt, Artificial Sequence
  Antisense Sequence
agggagcuguaggcugaagu

SEQ ID NO: 156 - RNA, 20 nt, Artificial Sequence
  Antisense Sequence
aagugagcagggagcuguag

SEQ ID NO: 157 - RNA, 20 nt, Artificial Sequence
  Antisense Sequence
uggacaggugaaaagugagc

SEQ ID NO: 158 - RNA, 20 nt, Artificial Sequence
  Antisense Sequence
guggacaggugaaaagugag

SEQ ID NO: 159 - RNA, 20 nt, Artificial Sequence
  Antisense Sequence
aguggacaggugaaaaguga

SEQ ID NO: 160 - RNA, 20 nt, Artificial Sequence
  Antisense Sequence
gaguggacaggugaaaagug

SEQ ID NO: 161 - RNA, 20 nt, Artificial Sequence
  Antisense Sequence
ggaguggacaggugaaaagu

SEQ ID NO: 162 - RNA, 20 nt, Artificial Sequence
  Antisense Sequence
aggaguggacaggugaaaag

SEQ ID NO: 163 - RNA, 20 nt, Artificial Sequence
  Antisense Sequence
gaggaguggacaggugaaaa

SEQ ID NO: 164 - RNA, 20 nt, Artificial Sequence
  Antisense Sequence
cgaggaguggacaggugaaa

SEQ ID NO: 165 - RNA, 20 nt, Artificial Sequence
  Antisense Sequence
ccgaggaguggacaggugaa

SEQ ID NO: 166 - RNA, 20 nt, Artificial Sequence
  Antisense Sequence
accgaggaguggacagguga

SEQ ID NO: 167 - RNA, 20 nt, Artificial Sequence
  Antisense Sequence
caugguacagguggugggac

SEQ ID NO: 168 - RNA, 20 nt, Artificial Sequence
  Antisense Sequence
gcaugguacaggugguggga

SEQ ID NO: 169 - RNA, 20 nt, Artificial Sequence
  Antisense Sequence
caaagagugccaggaagggu

SEQ ID NO: 170 - RNA, 20 nt, Artificial Sequence
  Antisense Sequence
gcaaagagugccaggaaggg

SEQ ID NO: 171 - RNA, 20 nt, Artificial Sequence
  Antisense Sequence
aagcaaagagugccaggaag

SEQ ID NO: 172 - RNA, 20 nt, Artificial Sequence
  Antisense Sequence
ucaagcaaagagugccagga

SEQ ID NO: 173 - RNA, 20 nt, Artificial Sequence
  Antisense Sequence
cucaagcaaagagugccagg

SEQ ID NO: 174 - RNA, 20 nt, Artificial Sequence
  Antisense Sequence
ccucaagcaaagagugccag

SEQ ID NO: 175 - RNA, 20 nt, Artificial Sequence
  Antisense Sequence
auccucaagcaaagagugcc

SEQ ID NO: 176 - RNA, 20 nt, Artificial Sequence
  Antisense Sequence
gauccucaagcaaagagugc

SEQ ID NO: 177 - RNA, 20 nt, Artificial Sequence
  Antisense Sequence
gaagauccucaagcaaagag

SEQ ID NO: 178 - RNA, 20 nt, Artificial Sequence
  Antisense Sequence
ggaagauccucaagcaaaga

SEQ ID NO: 179 - RNA, 20 nt, Artificial Sequence
  Antisense Sequence
cggaagauccucaagcaaag

SEQ ID NO: 180 - RNA, 20 nt, Artificial Sequence
  Antisense Sequence
aucggaagauccucaagcaa

SEQ ID NO: 181 - RNA, 20 nt, Artificial Sequence
  Antisense Sequence
caucggaagauccucaagca

SEQ ID NO: 182 - RNA, 20 nt, Artificial Sequence
  Antisense Sequence
ccaucggaagauccucaagc

SEQ ID NO: 183 - RNA, 20 nt, Artificial Sequence
  Antisense Sequence
cccaucggaagauccucaag

SEQ ID NO: 184 - RNA, 20 nt, Artificial Sequence
  Antisense Sequence
auguggugcucagccaggag

SEQ ID NO: 185 - RNA, 20 nt, Artificial Sequence
  Antisense Sequence
uuggugauguggugcucagc

SEQ ID NO: 186 - RNA, 20 nt, Artificial Sequence
  Antisense Sequence
gguuggugauguggugcuca

SEQ ID NO: 187 - RNA, 20 nt, Artificial Sequence
  Antisense Sequence
agguuggugauguggugcuc

SEQ ID NO: 188 - RNA, 20 nt, Artificial Sequence
  Antisense Sequence
cagguuggugauguggugcu

SEQ ID NO: 189 - RNA, 20 nt, Artificial Sequence
  Antisense Sequence
agcccagguuggugaugugg

SEQ ID NO: 190 - RNA, 20 nt, Artificial Sequence
  Antisense Sequence
cagcccagguuggugaugug

SEQ ID NO: 191 - RNA, 20 nt, Artificial Sequence
  Antisense Sequence
ugccagcccagguuggugau

SEQ ID NO: 192 - RNA, 20 nt, Artificial Sequence
  Antisense Sequence
augccagcccagguugguga

SEQ ID NO: 193 - RNA, 20 nt, Artificial Sequence
  Antisense Sequence
guaugccagcccagguuggu

SEQ ID NO: 194 - RNA, 20 nt, Artificial Sequence
  Antisense Sequence
agguaugccagcccagguug

SEQ ID NO: 195 - RNA, 20 nt, Artificial Sequence
  Antisense Sequence
aagguaugccagcccagguu

SEQ ID NO: 196 - RNA, 20 nt, Artificial Sequence
  Antisense Sequence
uaagguaugccagcccaggu

SEQ ID NO: 197 - RNA, 20 nt, Artificial Sequence
  Antisense Sequence
uuaagguaugccagcccagg

SEQ ID NO: 198 - RNA, 20 nt, Artificial Sequence
  Antisense Sequence
guuaagguaugccagcccag

SEQ ID NO: 199 - RNA, 20 nt, Artificial Sequence
  Antisense Sequence
aguuaagguaugccagccca

SEQ ID NO: 200 - RNA, 20 nt, Artificial Sequence
  Antisense Sequence
gaguuaagguaugccagccc

SEQ ID NO: 201 - RNA, 20 nt, Artificial Sequence
  Antisense Sequence
agaguuaagguaugccagcc

SEQ ID NO: 202 - RNA, 20 nt, Artificial Sequence
  Antisense Sequence
cagaguuaagguaugccagc

SEQ ID NO: 203 - RNA, 20 nt, Artificial Sequence
  Antisense Sequence
gcagaguuaagguaugccag

SEQ ID NO: 204 - RNA, 20 nt, Artificial Sequence
  Antisense Sequence
agggcagaguuaagguaugc

SEQ ID NO: 205 - RNA, 20 nt, Artificial Sequence
  Antisense Sequence
agagggcagaguuaagguau

SEQ ID NO: 206 - RNA, 20 nt, Artificial Sequence
  Antisense Sequence
uagagggcagaguuaaggua

SEQ ID NO: 207 - RNA, 20 nt, Artificial Sequence
  Antisense Sequence
cuagagggcagaguuaaggu

SEQ ID NO: 208 - RNA, 20 nt, Artificial Sequence
  Antisense Sequence
cacuagagggcagaguuaag

SEQ ID NO: 209 - RNA, 20 nt, Artificial Sequence
  Antisense Sequence
gccacuagagggcagaguua

SEQ ID NO: 210 - RNA, 20 nt, Artificial Sequence
  Antisense Sequence
ggacaccagacuucucaccc

SEQ ID NO: 211 - RNA, 20 nt, Artificial Sequence
  Antisense Sequence
aggacaccagacuucucacc

SEQ ID NO: 212 - RNA, 20 nt, Artificial Sequence
  Antisense Sequence
caggacaccagacuucucac

SEQ ID NO: 213 - RNA, 20 nt, Artificial Sequence
  Antisense Sequence
uuucaggacaccagacuucu

SEQ ID NO: 214 - RNA, 20 nt, Artificial Sequence
  Antisense Sequence
guuucaggacaccagacuuc

SEQ ID NO: 215 - RNA, 20 nt, Artificial Sequence
  Antisense Sequence
uaguugcaguuucaggacac

SEQ ID NO: 216 - RNA, 20 nt, Artificial Sequence
  Antisense Sequence
cuaguugcaguuucaggaca

SEQ ID NO: 217 - RNA, 20 nt, Artificial Sequence
  Antisense Sequence
ucuaguugcaguuucaggac

SEQ ID NO: 218 - RNA, 20 nt, Artificial Sequence
  Antisense Sequence
gucuaguugcaguuucagga

SEQ ID NO: 219 - RNA, 20 nt, Artificial Sequence
  Antisense Sequence
agucuaguugcaguuucagg

SEQ ID NO: 220 - RNA, 20 nt, Artificial Sequence
  Antisense Sequence
cagucuaguugcaguuucag

SEQ ID NO: 221 - RNA, 20 nt, Artificial Sequence
  Antisense Sequence
aacugugcuguugccuucua

SEQ ID NO: 222 - RNA, 20 nt, Artificial Sequence
  Antisense Sequence
uaacugugcuguugccuucu

SEQ ID NO: 223 - RNA, 20 nt, Artificial Sequence
  Antisense Sequence
guaacugugcuguugccuuc

SEQ ID NO: 224 - RNA, 20 nt, Artificial Sequence
  Antisense Sequence
ccaguaacugugcuguugcc

SEQ ID NO: 225 - RNA, 20 nt, Artificial Sequence
  Antisense Sequence
guccaguaacugugcuguug

SEQ ID NO: 226 - RNA, 20 nt, Artificial Sequence
  Antisense Sequence
uguccaguaacugugcuguu

SEQ ID NO: 227 - RNA, 20 nt, Artificial Sequence
  Antisense Sequence
uuguccaguaacugugcugu

SEQ ID NO: 228 - RNA, 20 nt, Artificial Sequence
  Antisense Sequence
gguuguccaguaacugugcu

SEQ ID NO: 229 - RNA, 20 nt, Artificial Sequence
  Antisense Sequence
cgguuguccaguaacugugc

SEQ ID NO: 230 - RNA, 20 nt, Artificial Sequence
  Antisense Sequence
ucgguuguccaguaacugug

SEQ ID NO: 231 - RNA, 20 nt, Artificial Sequence
  Antisense Sequence
cucgguuguccaguaacugu

SEQ ID NO: 232 - RNA, 20 nt, Artificial Sequence
  Antisense Sequence
ccucgguuguccaguaacug

SEQ ID NO: 233 - RNA, 20 nt, Artificial Sequence
  Antisense Sequence
gccucgguuguccaguaacu

SEQ ID NO: 234 - RNA, 20 nt, Artificial Sequence
  Antisense Sequence
cgccucgguuguccaguaac

SEQ ID NO: 235 - RNA, 20 nt, Artificial Sequence
  Antisense Sequence
ccgccucgguuguccaguaa

SEQ ID NO: 236 - RNA, 20 nt, Artificial Sequence
  Antisense Sequence
ugcugguguccugcuguguc

SEQ ID NO: 237 - RNA, 20 nt, Artificial Sequence
  Antisense Sequence
cugcugguguccugcugugu

SEQ ID NO: 238 - RNA, 20 nt, Artificial Sequence
  Antisense Sequence
ucuaggaagggcugcuggug

SEQ ID NO: 239 - RNA, 20 nt, Artificial Sequence
  Antisense Sequence
uuaagcucuaggaagggcug

SEQ ID NO: 240 - RNA, 20 nt, Artificial Sequence
  Antisense Sequence
cucauuggcucggaucuuaa

SEQ ID NO: 241 - RNA, 20 nt, Artificial Sequence
  Antisense Sequence
gcucauuggcucggaucuua

SEQ ID NO: 242 - RNA, 20 nt, Artificial Sequence
  Antisense Sequence
ggcucauuggcucggaucuu

SEQ ID NO: 243 - RNA, 20 nt, Artificial Sequence
  Antisense Sequence
aggcucauuggcucggaucu

SEQ ID NO: 244 - RNA, 20 nt, Artificial Sequence
  Antisense Sequence
caggcucauuggcucggauc

SEQ ID NO: 245 - RNA, 20 nt, Artificial Sequence
  Antisense Sequence
uccaggcucauuggcucgga

SEQ ID NO: 246 - RNA, 20 nt, Artificial Sequence
  Antisense Sequence
ucucgccugcaacauaaggg

SEQ ID NO: 247 - RNA, 20 nt, Artificial Sequence
  Antisense Sequence
cagaauggaaagaggcagca

SEQ ID NO: 248 - RNA, 20 nt, Artificial Sequence
  Antisense Sequence
gcagaauggaaagaggcagc

SEQ ID NO: 249 - RNA, 20 nt, Artificial Sequence
  Antisense Sequence
aagacggcagaauggaaaga

SEQ ID NO: 250 - RNA, 20 nt, Artificial Sequence
  Antisense Sequence
gaagacggcagaauggaaag

SEQ ID NO: 251 - RNA, 20 nt, Artificial Sequence
  Antisense Sequence
ugaagacggcagaauggaaa

SEQ ID NO: 252 - RNA, 20 nt, Artificial Sequence
  Antisense Sequence
cugaagacggcagaauggaa

SEQ ID NO: 253 - RNA, 20 nt, Artificial Sequence
  Antisense Sequence
gcugaagacggcagaaugga

SEQ ID NO: 254 - RNA, 20 nt, Artificial Sequence
  Antisense Sequence
ggcugaagacggcagaaugg

SEQ ID NO: 255 - RNA, 20 nt, Artificial Sequence
  Antisense Sequence
aggcugaagacggcagaaug

SEQ ID NO: 256 - RNA, 20 nt, Artificial Sequence
  Antisense Sequence
ggaggcugaagacggcagaa

SEQ ID NO: 257 - RNA, 20 nt, Artificial Sequence
  Antisense Sequence
aggaggcugaagacggcaga

SEQ ID NO: 258 - RNA, 20 nt, Artificial Sequence
  Antisense Sequence
uguuggcuuugaggaggcug

SEQ ID NO: 259 - RNA, 20 nt, Artificial Sequence
  Antisense Sequence
caaggauuguuggcuuugag

SEQ ID NO: 260 - RNA, 20 nt, Artificial Sequence
  Antisense Sequence
uggcaggccaaggauuguug

SEQ ID NO: 261 - RNA, 20 nt, Artificial Sequence
  Antisense Sequence
cuggcaggccaaggauuguu

SEQ ID NO: 262 - RNA, 20 nt, Artificial Sequence
  Antisense Sequence
acuggcaggccaaggauugu

SEQ ID NO: 263 - RNA, 20 nt, Artificial Sequence
  Antisense Sequence
aggagguacuggcaggccaa

SEQ ID NO: 264 - RNA, 20 nt, Artificial Sequence
  Antisense Sequence
aacaggagguacuggcaggc

SEQ ID NO: 265 - RNA, 20 nt, Artificial Sequence
  Antisense Sequence
caacaggagguacuggcagg

SEQ ID NO: 266 - RNA, 20 nt, Artificial Sequence
  Antisense Sequence
acacaacaggagguacuggc

SEQ ID NO: 267 - RNA, 20 nt, Artificial Sequence
  Antisense Sequence
agggacacaacaggagguac

SEQ ID NO: 268 - RNA, 20 nt, Artificial Sequence
  Antisense Sequence
ucgggcaguagggacacaac

SEQ ID NO: 269 - RNA, 20 nt, Artificial Sequence
  Antisense Sequence
uucgggcaguagggacacaa

SEQ ID NO: 270 - RNA, 20 nt, Artificial Sequence
  Antisense Sequence
cuucgggcaguagggacaca

SEQ ID NO: 271 - RNA, 20 nt, Artificial Sequence
  Antisense Sequence
augauccagguagaggagag

SEQ ID NO: 272 - RNA, 20 nt, Artificial Sequence
  Antisense Sequence
uaugauccagguagaggaga

SEQ ID NO: 273 - RNA, 20 nt, Artificial Sequence
  Antisense Sequence
uuaugauccagguagaggag

SEQ ID NO: 274 - RNA, 20 nt, Artificial Sequence
  Antisense Sequence
auuaugauccagguagagga

SEQ ID NO: 275 - RNA, 20 nt, Artificial Sequence
  Antisense Sequence
cauuaugauccagguagagg

SEQ ID NO: 276 - RNA, 20 nt, Artificial Sequence
  Antisense Sequence
ccauuaugauccagguagag

SEQ ID NO: 277 - RNA, 20 nt, Artificial Sequence
  Antisense Sequence
ugccauuaugauccagguag

SEQ ID NO: 278 - RNA, 20 nt, Artificial Sequence
  Antisense Sequence
uugccauuaugauccaggua

SEQ ID NO: 279 - RNA, 20 nt, Artificial Sequence
  Antisense Sequence
auugccauuaugauccaggu

SEQ ID NO: 280 - RNA, 20 nt, Artificial Sequence
  Antisense Sequence
cauugccauuaugauccagg

SEQ ID NO: 281 - RNA, 20 nt, Artificial Sequence
  Antisense Sequence
acauugccauuaugauccag

SEQ ID NO: 282 - RNA, 20 nt, Artificial Sequence
  Antisense Sequence
ccacauugccauuaugaucc

SEQ ID NO: 283 - RNA, 20 nt, Artificial Sequence
  Antisense Sequence
gaccacauugccauuaugau

SEQ ID NO: 284 - RNA, 20 nt, Artificial Sequence
  Antisense Sequence
ugaccacauugccauuauga

SEQ ID NO: 285 - RNA, 20 nt, Artificial Sequence
  Antisense Sequence
uugaccacauugccauuaug

SEQ ID NO: 286 - RNA, 20 nt, Artificial Sequence
  Antisense Sequence
ucuugaccacauugccauua

SEQ ID NO: 287 - RNA, 20 nt, Artificial Sequence
  Antisense Sequence
gucuugaccacauugccauu

SEQ ID NO: 288 - RNA, 20 nt, Artificial Sequence
  Antisense Sequence
cgucuugaccacauugccau

SEQ ID NO: 289 - RNA, 20 nt, Artificial Sequence
  Antisense Sequence
ccgucuugaccacauugcca

SEQ ID NO: 290 - RNA, 20 nt, Artificial Sequence
  Antisense Sequence
uccgucuugaccacauugcc

SEQ ID NO: 291 - RNA, 20 nt, Artificial Sequence
  Antisense Sequence
auccgucuugaccacauugc

SEQ ID NO: 292 - RNA, 20 nt, Artificial Sequence
  Antisense Sequence
cauccgucuugaccacauug

SEQ ID NO: 293 - RNA, 20 nt, Artificial Sequence
  Antisense Sequence
acauccgucuugaccacauu

SEQ ID NO: 294 - RNA, 20 nt, Artificial Sequence
  Antisense Sequence
cacauccgucuugaccacau

SEQ ID NO: 295 - RNA, 20 nt, Artificial Sequence
  Antisense Sequence
gcacauccgucuugaccaca

SEQ ID NO: 296 - RNA, 20 nt, Artificial Sequence
  Antisense Sequence
ggcacauccgucuugaccac

SEQ ID NO: 297 - RNA, 20 nt, Artificial Sequence
  Antisense Sequence
uggcacauccgucuugacca

SEQ ID NO: 298 - RNA, 20 nt, Artificial Sequence
  Antisense Sequence
cuggcacauccgucuugacc

SEQ ID NO: 299 - RNA, 20 nt, Artificial Sequence
  Antisense Sequence
ucuggcacauccgucuugac

SEQ ID NO: 300 - RNA, 20 nt, Artificial Sequence
  Antisense Sequence
aucuggcacauccgucuuga

SEQ ID NO: 301 - RNA, 20 nt, Artificial Sequence
  Antisense Sequence
uaucuggcacauccgucuug

SEQ ID NO: 302 - RNA, 20 nt, Artificial Sequence
  Antisense Sequence
auaucuggcacauccgucuu

SEQ ID NO: 303 - RNA, 20 nt, Artificial Sequence
  Antisense Sequence
cauaucuggcacauccgucu

SEQ ID NO: 304 - RNA, 20 nt, Artificial Sequence
  Antisense Sequence
ccauaucuggcacauccguc

SEQ ID NO: 305 - RNA, 20 nt, Artificial Sequence
  Antisense Sequence
caccauaucuggcacauccg

SEQ ID NO: 306 - RNA, 20 nt, Artificial Sequence
  Antisense Sequence
cuccaccaccauaucuggca

SEQ ID NO: 307 - RNA, 20 nt, Artificial Sequence
  Antisense Sequence
uggucucuucacuccaaagc

SEQ ID NO: 308 - RNA, 20 nt, Artificial Sequence
  Antisense Sequence
cuucaucuuggucucuucac

SEQ ID NO: 309 - RNA, 20 nt, Artificial Sequence
  Antisense Sequence
acuucaucuuggucucuuca

SEQ ID NO: 310 - RNA, 20 nt, Artificial Sequence
  Antisense Sequence
aacuucaucuuggucucuuc

SEQ ID NO: 311 - RNA, 20 nt, Artificial Sequence
  Antisense Sequence
ggaaacuucaucuuggucuc

SEQ ID NO: 312 - RNA, 20 nt, Artificial Sequence
  Antisense Sequence
ccuccagucacagaugcccu

SEQ ID NO: 313 - RNA, 20 nt, Artificial Sequence
  Antisense Sequence
gaugccuccagucacagaug

SEQ ID NO: 314 - RNA, 20 nt, Artificial Sequence
  Antisense Sequence
ugaugccuccagucacagau

SEQ ID NO: 315 - RNA, 20 nt, Artificial Sequence
  Antisense Sequence
caggugguuguuggguuggg

SEQ ID NO: 316 - RNA, 20 nt, Artificial Sequence
  Antisense Sequence
ccaggugguuguuggguugg

SEQ ID NO: 317 - RNA, 20 nt, Artificial Sequence
  Antisense Sequence
gccaggugguuguuggguug

SEQ ID NO: 318 - RNA, 20 nt, Artificial Sequence
  Antisense Sequence
ugccaggugguuguuggguu

SEQ ID NO: 319 - RNA, 20 nt, Artificial Sequence
  Antisense Sequence
cauauugccaggugguuguu

SEQ ID NO: 320 - RNA, 20 nt, Artificial Sequence
  Antisense Sequence
ucauauugccaggugguugu

SEQ ID NO: 321 - RNA, 20 nt, Artificial Sequence
  Antisense Sequence
gucauauugccaggugguug

SEQ ID NO: 322 - RNA, 20 nt, Artificial Sequence
  Antisense Sequence
agucauauugccaggugguu

SEQ ID NO: 323 - RNA, 20 nt, Artificial Sequence
  Antisense Sequence
gagucauauugccagguggu

SEQ ID NO: 324 - RNA, 20 nt, Artificial Sequence
  Antisense Sequence
agugagucauauugccaggu

SEQ ID NO: 325 - RNA, 20 nt, Artificial Sequence
  Antisense Sequence
aagugagucauauugccagg

SEQ ID NO: 326 - RNA, 20 nt, Artificial Sequence
  Antisense Sequence
caagugagucauauugccag

SEQ ID NO: 327 - RNA, 20 nt, Artificial Sequence
  Antisense Sequence
gucaagugagucauauugcc

SEQ ID NO: 328 - RNA, 20 nt, Artificial Sequence
  Antisense Sequence
ggucaagugagucauauugc

SEQ ID NO: 329 - RNA, 20 nt, Artificial Sequence
  Antisense Sequence
gggucaagugagucauauug

SEQ ID NO: 330 - RNA, 20 nt, Artificial Sequence
  Antisense Sequence
cccauuugggucccauaggg

SEQ ID NO: 331 - RNA, 20 nt, Artificial Sequence
  Antisense Sequence
gcccauuugggucccauagg

SEQ ID NO: 332 - RNA, 20 nt, Artificial Sequence
  Antisense Sequence
ugcccauuugggucccauag

SEQ ID NO: 333 - RNA, 20 nt, Artificial Sequence
  Antisense Sequence
gugcccauuugggucccaua

SEQ ID NO: 334 - RNA, 20 nt, Artificial Sequence
  Antisense Sequence
agugcccauuugggucccau

SEQ ID NO: 335 - RNA, 20 nt, Artificial Sequence
  Antisense Sequence
aagugcccauuuggguccca

SEQ ID NO: 336 - RNA, 20 nt, Artificial Sequence
  Antisense Sequence
aaagugcccauuuggguccc

SEQ ID NO: 337 - RNA, 20 nt, Artificial Sequence
  Antisense Sequence
gaaagugcccauuugggucc

SEQ ID NO: 338 - RNA, 20 nt, Artificial Sequence
  Antisense Sequence
agaaagugcccauuuggguc

SEQ ID NO: 339 - RNA, 20 nt, Artificial Sequence
  Antisense Sequence
caagaaagugcccauuuggg

SEQ ID NO: 340 - RNA, 20 nt, Artificial Sequence
  Antisense Sequence
acaagaaagugcccauuugg

SEQ ID NO: 341 - RNA, 20 nt, Artificial Sequence
  Antisense Sequence
gacaagaaagugcccauuug

SEQ ID NO: 342 - RNA, 20 nt, Artificial Sequence
  Antisense Sequence
gagucucagacaagaaagug

SEQ ID NO: 343 - RNA, 20 nt, Artificial Sequence
  Antisense Sequence
ccagagucucagacaagaaa

SEQ ID NO: 344 - RNA, 20 nt, Artificial Sequence
  Antisense Sequence
gccagagucucagacaagaa

SEQ ID NO: 345 - RNA, 20 nt, Artificial Sequence
  Antisense Sequence
agccagagucucagacaaga

SEQ ID NO: 346 - RNA, 20 nt, Artificial Sequence
  Antisense Sequence
uaagccagagucucagacaa

SEQ ID NO: 347 - RNA, 20 nt, Artificial Sequence
  Antisense Sequence
auaagccagagucucagaca

SEQ ID NO: 348 - RNA, 20 nt, Artificial Sequence
  Antisense Sequence
agccaaccuggaauaagcca

SEQ ID NO: 349 - RNA, 20 nt, Artificial Sequence
  Antisense Sequence
ucagccaaccuggaauaagc

SEQ ID NO: 350 - RNA, 20 nt, Artificial Sequence
  Antisense Sequence
caucagccaaccuggaauaa

SEQ ID NO: 351 - RNA, 20 nt, Artificial Sequence
  Antisense Sequence
cacaucagccaaccuggaau

SEQ ID NO: 352 - RNA, 20 nt, Artificial Sequence
  Antisense Sequence
acacaucagccaaccuggaa

SEQ ID NO: 353 - RNA, 20 nt, Artificial Sequence
  Antisense Sequence
aacacaucagccaaccugga

SEQ ID NO: 354 - RNA, 20 nt, Artificial Sequence
  Antisense Sequence
caacacaucagccaaccugg

SEQ ID NO: 355 - RNA, 20 nt, Artificial Sequence
  Antisense Sequence
cucccaacacaucagccaac

SEQ ID NO: 356 - RNA, 20 nt, Artificial Sequence
  Antisense Sequence
cgcuuuacccaucucccaac

SEQ ID NO: 357 - RNA, 20 nt, Artificial Sequence
  Antisense Sequence
aacgcuuuacccaucuccca

SEQ ID NO: 358 - RNA, 20 nt, Artificial Sequence
  Antisense Sequence
aaacgcuuuacccaucuccc

SEQ ID NO: 359 - RNA, 20 nt, Artificial Sequence
  Antisense Sequence
agaaacgcuuuacccaucuc

SEQ ID NO: 360 - RNA, 20 nt, Artificial Sequence
  Antisense Sequence
aagaaacgcuuuacccaucu

SEQ ID NO: 361 - RNA, 20 nt, Artificial Sequence
  Antisense Sequence
gaagaaacgcuuuacccauc

SEQ ID NO: 362 - RNA, 20 nt, Artificial Sequence
  Antisense Sequence
agaagaaacgcuuuacccau

SEQ ID NO: 363 - RNA, 20 nt, Artificial Sequence
  Antisense Sequence
uagaagaaacgcuuuaccca

SEQ ID NO: 364 - RNA, 20 nt, Artificial Sequence
  Antisense Sequence
uuagaagaaacgcuuuaccc

SEQ ID NO: 365 - RNA, 20 nt, Artificial Sequence
  Antisense Sequence
aaucaugcuuucuggguaga

SEQ ID NO: 366 - RNA, 20 nt, Artificial Sequence
  Antisense Sequence
cuuagggcaggaaaucaugc

SEQ ID NO: 367 - RNA, 20 nt, Artificial Sequence
  Antisense Sequence
acuuagggcaggaaaucaug

SEQ ID NO: 368 - RNA, 20 nt, Artificial Sequence
  Antisense Sequence
gacuuagggcaggaaaucau

SEQ ID NO: 369 - RNA, 20 nt, Artificial Sequence
  Antisense Sequence
aggacuuagggcaggaaauc

SEQ ID NO: 370 - RNA, 20 nt, Artificial Sequence
  Antisense Sequence
caggacuuagggcaggaaau

SEQ ID NO: 371 - RNA, 20 nt, Artificial Sequence
  Antisense Sequence
acaggacuuagggcaggaaa

SEQ ID NO: 372 - RNA, 20 nt, Artificial Sequence
  Antisense Sequence
ucucacaggacuuagggcag

SEQ ID NO: 373 - RNA, 20 nt, Artificial Sequence
  Antisense Sequence
uucucacaggacuuagggca

SEQ ID NO: 374 - RNA, 20 nt, Artificial Sequence
  Antisense Sequence
aucuucucacaggacuuagg

SEQ ID NO: 375 - RNA, 20 nt, Artificial Sequence
  Antisense Sequence
caucuucucacaggacuuag

SEQ ID NO: 376 - RNA, 20 nt, Artificial Sequence
  Antisense Sequence
uagucccugacaucuucuca

SEQ ID NO: 377 - RNA, 20 nt, Artificial Sequence
  Antisense Sequence
cuagucccugacaucuucuc

SEQ ID NO: 378 - RNA, 20 nt, Artificial Sequence
  Antisense Sequence
ccuagucccugacaucuucu

SEQ ID NO: 379 - RNA, 20 nt, Artificial Sequence
  Antisense Sequence
cccuagucccugacaucuuc

SEQ ID NO: 380 - RNA, 20 nt, Artificial Sequence
  Antisense Sequence
ucccuagucccugacaucuu

SEQ ID NO: 381 - RNA, 20 nt, Artificial Sequence
  Antisense Sequence
cucccuagucccugacaucu

SEQ ID NO: 382 - RNA, 20 nt, Artificial Sequence
  Antisense Sequence
aucuaucugcuuccuccucc

SEQ ID NO: 383 - RNA, 20 nt, Artificial Sequence
  Antisense Sequence
ccaucuaucugcuuccuccu

SEQ ID NO: 384 - RNA, 20 nt, Artificial Sequence
  Antisense Sequence
accaucuaucugcuuccucc

SEQ ID NO: 385 - RNA, 20 nt, Artificial Sequence
  Antisense Sequence
gaccaucuaucugcuuccuc

SEQ ID NO: 386 - RNA, 20 nt, Artificial Sequence
  Antisense Sequence
ggaccaucuaucugcuuccu

SEQ ID NO: 387 - RNA, 20 nt, Artificial Sequence
  Antisense Sequence
uggaccaucuaucugcuucc

SEQ ID NO: 388 - RNA, 20 nt, Artificial Sequence
  Antisense Sequence
cuggaccaucuaucugcuuc

SEQ ID NO: 389 - RNA, 20 nt, Artificial Sequence
  Antisense Sequence
cugcuggaccaucuaucugc

SEQ ID NO: 390 - RNA, 20 nt, Artificial Sequence
  Antisense Sequence
gccugcuggaccaucuaucu

SEQ ID NO: 391 - RNA, 20 nt, Artificial Sequence
  Antisense Sequence
uucaagccugcuggaccauc

SEQ ID NO: 392 - RNA, 20 nt, Artificial Sequence
  Antisense Sequence
ugcuucaagccugcuggacc

SEQ ID NO: 393 - RNA, 20 nt, Artificial Sequence
  Antisense Sequence
ccucaacagcccuuacccug

SEQ ID NO: 394 - RNA, 20 nt, Artificial Sequence
  Antisense Sequence
ucccucuugaccuucccuua

SEQ ID NO: 395 - RNA, 20 nt, Artificial Sequence
  Antisense Sequence
cucccucuugaccuucccuu

SEQ ID NO: 396 - RNA, 20 nt, Artificial Sequence
  Antisense Sequence
ucucccucuugaccuucccu

SEQ ID NO: 397 - RNA, 20 nt, Artificial Sequence
  Antisense Sequence
caucucccucuugaccuucc

SEQ ID NO: 398 - RNA, 20 nt, Artificial Sequence
  Antisense Sequence
ccaucucccucuugaccuuc

SEQ ID NO: 399 - RNA, 20 nt, Artificial Sequence
  Antisense Sequence
cccaucucccucuugaccuu

SEQ ID NO: 400 - RNA, 20 nt, Artificial Sequence
  Antisense Sequence
gcccaucucccucuugaccu

SEQ ID NO: 401 - RNA, 20 nt, Artificial Sequence
  Antisense Sequence
uugcccaucucccucuugac

SEQ ID NO: 402 - RNA, 20 nt, Artificial Sequence
  Antisense Sequence
cuugcccaucucccucuuga

SEQ ID NO: 403 - RNA, 20 nt, Artificial Sequence
  Antisense Sequence
cccuaagcauccucccucag

SEQ ID NO: 404 - RNA, 20 nt, Artificial Sequence
  Antisense Sequence
aacuucuuaggcuuagugcc

SEQ ID NO: 405 - RNA, 20 nt, Artificial Sequence
  Antisense Sequence
ggaacuucuuaggcuuagug

SEQ ID NO: 406 - RNA, 20 nt, Artificial Sequence
  Antisense Sequence
gggaacuucuuaggcuuagu

SEQ ID NO: 407 - RNA, 20 nt, Artificial Sequence
  Antisense Sequence
agggaacuucuuaggcuuag

SEQ ID NO: 408 - RNA, 20 nt, Artificial Sequence
  Antisense Sequence
ugucucccaguggguccugu

SEQ ID NO: 409 - RNA, 20 nt, Artificial Sequence
  Antisense Sequence
aguauaaaugcuugucuccc

SEQ ID NO: 410 - RNA, 20 nt, Artificial Sequence
  Antisense Sequence
gacagagcgagacucgaucu

SEQ ID NO: 411 - RNA, 20 nt, Artificial Sequence
  Antisense Sequence
ugacagagcgagacucgauc

SEQ ID NO: 412 - RNA, 20 nt, Artificial Sequence
  Antisense Sequence
gugacagagcgagacucgau

SEQ ID NO: 413 - RNA, 20 nt, Artificial Sequence
  Antisense Sequence
ggugacagagcgagacucga

SEQ ID NO: 414 - RNA, 20 nt, Artificial Sequence
  Antisense Sequence
uggugacagagcgagacucg

SEQ ID NO: 415 - RNA, 20 nt, Artificial Sequence
  Antisense Sequence
cuggugacagagcgagacuc

SEQ ID NO: 416 - RNA, 20 nt, Artificial Sequence
  Antisense Sequence
ccuggugacagagcgagacu

SEQ ID NO: 417 - RNA, 20 nt, Artificial Sequence
  Antisense Sequence
agccuggugacagagcgaga

SEQ ID NO: 418 - RNA, 20 nt, Artificial Sequence
  Antisense Sequence
ugcacuccagccuggugaca

SEQ ID NO: 419 - RNA, 20 nt, Artificial Sequence
  Antisense Sequence
acugcacuccagccugguga

SEQ ID NO: 420 - RNA, 20 nt, Artificial Sequence
  Antisense Sequence
ucacugcacuccagccuggu

SEQ ID NO: 421 - RNA, 20 nt, Artificial Sequence
  Antisense Sequence
ugucacugcacuccagccug

SEQ ID NO: 422 - RNA, 20 nt, Artificial Sequence
  Antisense Sequence
gugucacugcacuccagccu

SEQ ID NO: 423 - RNA, 20 nt, Artificial Sequence
  Antisense Sequence
agacggagguugcagugagc

SEQ ID NO: 424 - RNA, 20 nt, Artificial Sequence
  Antisense Sequence
gagacggagguugcagugag

SEQ ID NO: 425 - RNA, 20 nt, Artificial Sequence
  Antisense Sequence
ggagacggagguugcaguga

SEQ ID NO: 426 - RNA, 20 nt, Artificial Sequence
  Antisense Sequence
acuugaacccaggagacgga

SEQ ID NO: 427 - RNA, 20 nt, Artificial Sequence
  Antisense Sequence
cacuugaacccaggagacgg

SEQ ID NO: 428 - RNA, 20 nt, Artificial Sequence
  Antisense Sequence
ucacuugaacccaggagacg

SEQ ID NO: 429 - RNA, 20 nt, Artificial Sequence
  Antisense Sequence
aucacuugaacccaggagac

SEQ ID NO: 430 - RNA, 20 nt, Artificial Sequence
  Antisense Sequence
aaucacuugaacccaggaga

SEQ ID NO: 431 - RNA, 20 nt, Artificial Sequence
  Antisense Sequence
gaaucacuugaacccaggag

SEQ ID NO: 432 - RNA, 20 nt, Artificial Sequence
  Antisense Sequence
agaaucacuugaacccagga

SEQ ID NO: 433 - RNA, 20 nt, Artificial Sequence
  Antisense Sequence
aagaaucacuugaacccagg

SEQ ID NO: 434 - RNA, 20 nt, Artificial Sequence
  Antisense Sequence
gaagaaucacuugaacccag

SEQ ID NO: 435 - RNA, 20 nt, Artificial Sequence
  Antisense Sequence
agaagaaucacuugaaccca

SEQ ID NO: 436 - RNA, 20 nt, Artificial Sequence
  Antisense Sequence
cagaagaaucacuugaaccc

SEQ ID NO: 437 - RNA, 20 nt, Artificial Sequence
  Antisense Sequence
gcagaagaaucacuugaacc

SEQ ID NO: 438 - RNA, 20 nt, Artificial Sequence
  Antisense Sequence
ggcagaagaaucacuugaac

SEQ ID NO: 439 - RNA, 20 nt, Artificial Sequence
  Antisense Sequence
aggcagaagaaucacuugaa

SEQ ID NO: 440 - RNA, 20 nt, Artificial Sequence
  Antisense Sequence
gaggcagaagaaucacuuga

SEQ ID NO: 441 - RNA, 20 nt, Artificial Sequence
  Antisense Sequence
ugaggcagaagaaucacuug

SEQ ID NO: 442 - RNA, 20 nt, Artificial Sequence
  Antisense Sequence
cugaggcagaagaaucacuu

SEQ ID NO: 443 - RNA, 20 nt, Artificial Sequence
  Antisense Sequence
gcugaggcagaagaaucacu

SEQ ID NO: 444 - RNA, 20 nt, Artificial Sequence
  Antisense Sequence
ggcugaggcagaagaaucac

SEQ ID NO: 445 - RNA, 20 nt, Artificial Sequence
  Antisense Sequence
aggcugaggcagaagaauca

SEQ ID NO: 446 - RNA, 20 nt, Artificial Sequence
  Antisense Sequence
gaggcugaggcagaagaauc

SEQ ID NO: 447 - RNA, 20 nt, Artificial Sequence
  Antisense Sequence
ggaggcugaggcagaagaau

SEQ ID NO: 448 - RNA, 20 nt, Artificial Sequence
  Antisense Sequence
gggaggcugaggcagaagaa

SEQ ID NO: 449 - RNA, 20 nt, Artificial Sequence
  Antisense Sequence
agauugagaccauccuggcc

SEQ ID NO: 450 - RNA, 20 nt, Artificial Sequence
  Antisense Sequence
gagauugagaccauccuggc

SEQ ID NO: 451 - RNA, 20 nt, Artificial Sequence
  Antisense Sequence
agagauugagaccauccugg

SEQ ID NO: 452 - RNA, 20 nt, Artificial Sequence
  Antisense Sequence
aagagauugagaccauccug

SEQ ID NO: 453 - RNA, 20 nt, Artificial Sequence
  Antisense Sequence
caagagauugagaccauccu

SEQ ID NO: 454 - RNA, 20 nt, Artificial Sequence
  Antisense Sequence
gguggcucacgccuauaauc

SEQ ID NO: 455 - RNA, 20 nt, Artificial Sequence
  Antisense Sequence
cgguggcucacgccuauaau

SEQ ID NO: 456 - RNA, 20 nt, Artificial Sequence
  Antisense Sequence
gcgguggcucacgccuauaa

SEQ ID NO: 457 - RNA, 20 nt, Artificial Sequence
  Antisense Sequence
cccuaacccuucuuuaugac

SEQ ID NO: 458 - RNA, 20 nt, Artificial Sequence
  Antisense Sequence
cacccuaacccuucuuuaug

SEQ ID NO: 459 - RNA, 20 nt, Artificial Sequence
  Antisense Sequence
aucacccuaacccuucuuua

SEQ ID NO: 460 - RNA, 20 nt, Artificial Sequence
  Antisense Sequence
caucacccuaacccuucuuu

SEQ ID NO: 461 - RNA, 20 nt, Artificial Sequence
  Antisense Sequence
ccaucacccuaacccuucuu

SEQ ID NO: 462 - RNA, 20 nt, Artificial Sequence
  Antisense Sequence
gaccaucacccuaacccuuc

SEQ ID NO: 463 - RNA, 20 nt, Artificial Sequence
  Antisense Sequence
ggaccaucacccuaacccuu

SEQ ID NO: 464 - RNA, 20 nt, Artificial Sequence
  Antisense Sequence
uggaccaucacccuaacccu

SEQ ID NO: 465 - RNA, 20 nt, Artificial Sequence
  Antisense Sequence
cuggaccaucacccuaaccc

SEQ ID NO: 466 - RNA, 20 nt, Artificial Sequence
  Antisense Sequence
ucuggaccaucacccuaacc

SEQ ID NO: 467 - RNA, 20 nt, Artificial Sequence
  Antisense Sequence
cucuggaccaucacccuaac

SEQ ID NO: 468 - RNA, 20 nt, Artificial Sequence
  Antisense Sequence
gcucuggaccaucacccuaa

SEQ ID NO: 469 - RNA, 20 nt, Artificial Sequence
  Antisense Sequence
ugcucuggaccaucacccua

SEQ ID NO: 470 - RNA, 20 nt, Artificial Sequence
  Antisense Sequence
guugcucuggaccaucaccc

SEQ ID NO: 471 - RNA, 20 nt, Artificial Sequence
  Antisense Sequence
uguugcucuggaccaucacc

SEQ ID NO: 472 - RNA, 20 nt, Artificial Sequence
  Antisense Sequence
acuguugcucuggaccauca

SEQ ID NO: 473 - RNA, 20 nt, Artificial Sequence
  Antisense Sequence
aacuguugcucuggaccauc

SEQ ID NO: 474 - RNA, 20 nt, Artificial Sequence
  Antisense Sequence
gaacuguugcucuggaccau

SEQ ID NO: 475 - RNA, 20 nt, Artificial Sequence
  Antisense Sequence
gaagaacuguugcucuggac

SEQ ID NO: 476 - RNA, 20 nt, Artificial Sequence
  Antisense Sequence
uugaagaacuguugcucugg

SEQ ID NO: 477 - RNA, 20 nt, Artificial Sequence
  Antisense Sequence
acuugaagaacuguugcucu

SEQ ID NO: 478 - RNA, 20 nt, Artificial Sequence
  Antisense Sequence
cacuugaagaacuguugcuc

SEQ ID NO: 479 - RNA, 20 nt, Artificial Sequence
  Antisense Sequence
uacacuugaagaacuguugc

SEQ ID NO: 480 - RNA, 20 nt, Artificial Sequence
  Antisense Sequence
gaguacacuugaagaacugu

SEQ ID NO: 481 - RNA, 20 nt, Artificial Sequence
  Antisense Sequence
agaguacacuugaagaacug

SEQ ID NO: 482 - RNA, 20 nt, Artificial Sequence
  Antisense Sequence
cagaguacacuugaagaacu

SEQ ID NO: 483 - RNA, 20 nt, Artificial Sequence
  Antisense Sequence
acagaguacacuugaagaac

SEQ ID NO: 484 - RNA, 20 nt, Artificial Sequence
  Antisense Sequence
cuacagaguacacuugaaga

SEQ ID NO: 485 - RNA, 20 nt, Artificial Sequence
  Antisense Sequence
ccuacagaguacacuugaag

SEQ ID NO: 486 - RNA, 20 nt, Artificial Sequence
  Antisense Sequence
gccuacagaguacacuugaa

SEQ ID NO: 487 - RNA, 20 nt, Artificial Sequence
  Antisense Sequence
agccuacagaguacacuuga

SEQ ID NO: 488 - RNA, 20 nt, Artificial Sequence
  Antisense Sequence
aagccuacagaguacacuug

SEQ ID NO: 489 - RNA, 20 nt, Artificial Sequence
  Antisense Sequence
cagaagccuacagaguacac

SEQ ID NO: 490 - RNA, 20 nt, Artificial Sequence
  Antisense Sequence
ccagaagccuacagaguaca

SEQ ID NO: 491 - RNA, 20 nt, Artificial Sequence
  Antisense Sequence
aaaagggaccucccagaagc

SEQ ID NO: 492 - RNA, 20 nt, Artificial Sequence
  Antisense Sequence
gaaaagggaccucccagaag

SEQ ID NO: 493 - RNA, 20 nt, Artificial Sequence
  Antisense Sequence
ugaaaagggaccucccagaa

SEQ ID NO: 494 - RNA, 20 nt, Artificial Sequence
  Antisense Sequence
cuuugacuuuguggacaccc

SEQ ID NO: 495 - RNA, 20 nt, Artificial Sequence
  Antisense Sequence
gcuuugacuuuguggacacc

SEQ ID NO: 496 - RNA, 20 nt, Artificial Sequence
  Antisense Sequence
uagcuuugacuuuguggaca

SEQ ID NO: 497 - RNA, 20 nt, Artificial Sequence
  Antisense Sequence
auagcuuugacuuuguggac

SEQ ID NO: 498 - RNA, 20 nt, Artificial Sequence
  Antisense Sequence
gucacacggccucuggaaaa

SEQ ID NO: 499 - RNA, 20 nt, Artificial Sequence
  Antisense Sequence
ugucacacggccucuggaaa

SEQ ID NO: 500 - RNA, 20 nt, Artificial Sequence
  Antisense Sequence
augucacacggccucuggaa

SEQ ID NO: 501 - RNA, 20 nt, Artificial Sequence
  Antisense Sequence
cuuagucacuuuucccaaga

SEQ ID NO: 502 - RNA, 20 nt, Artificial Sequence
  Antisense Sequence
ucuuagucacuuuucccaag

SEQ ID NO: 503 - RNA, 20 nt, Artificial Sequence
  Antisense Sequence
cucuuagcaucuuagucacu

SEQ ID NO: 504 - RNA, 20 nt, Artificial Sequence
  Antisense Sequence
gcucuuagcaucuuagucac

SEQ ID NO: 505 - RNA, 20 nt, Artificial Sequence
  Antisense Sequence
uacgcucuuagcaucuuagu

SEQ ID NO: 506 - RNA, 20 nt, Artificial Sequence
  Antisense Sequence
auacgcucuuagcaucuuag

SEQ ID NO: 507 - RNA, 20 nt, Artificial Sequence
  Antisense Sequence
cucagcuauaaauacgcucu

SEQ ID NO: 508 - RNA, 20 nt, Artificial Sequence
  Antisense Sequence
gcucagcuauaaauacgcuc

SEQ ID NO: 509 - RNA, 20 nt, Artificial Sequence
  Antisense Sequence
agcucagcuauaaauacgcu

SEQ ID NO: 510 - RNA, 20 nt, Artificial Sequence
  Antisense Sequence
acccucacugucagaugccc

SEQ ID NO: 511 - RNA, 20 nt, Artificial Sequence
  Antisense Sequence
cacccucacugucagaugcc

SEQ ID NO: 512 - RNA, 20 nt, Artificial Sequence
  Antisense Sequence
cccacccucacugucagaug

SEQ ID NO: 513 - RNA, 20 nt, Artificial Sequence
  Antisense Sequence
gggaagugacaagaaguggc

SEQ ID NO: 514 - RNA, 20 nt, Artificial Sequence
  Antisense Sequence
guaucaguaggcagucaggg

SEQ ID NO: 515 - RNA, 20 nt, Artificial Sequence
  Antisense Sequence
gguaucaguaggcagucagg

SEQ ID NO: 516 - RNA, 20 nt, Artificial Sequence
  Antisense Sequence
guugguaucaguaggcaguc

SEQ ID NO: 517 - RNA, 20 nt, Artificial Sequence
  Antisense Sequence
uguugguaucaguaggcagu

SEQ ID NO: 518 - RNA, 20 nt, Artificial Sequence
  Antisense Sequence
ccuguugguaucaguaggca

SEQ ID NO: 519 - RNA, 20 nt, Artificial Sequence
  Antisense Sequence
accuguugguaucaguaggc

SEQ ID NO: 520 - RNA, 20 nt, Artificial Sequence
  Antisense Sequence
cagacggcuuaccuguuggu

SEQ ID NO: 521 - RNA, 20 nt, Artificial Sequence
  Antisense Sequence
ucagacggcuuaccuguugg

SEQ ID NO: 522 - RNA, 20 nt, Artificial Sequence
  Antisense Sequence
cucagacggcuuaccuguug

SEQ ID NO: 523 - RNA, 20 nt, Artificial Sequence
  Antisense Sequence
ccucagacggcuuaccuguu

SEQ ID NO: 524 - RNA, 20 nt, Artificial Sequence
  Antisense Sequence
gccucagacggcuuaccugu

SEQ ID NO: 525 - RNA, 20 nt, Artificial Sequence
  Antisense Sequence
ugccucagacggcuuaccug

SEQ ID NO: 526 - RNA, 20 nt, Artificial Sequence
  Antisense Sequence
gugccucagacggcuuaccu

SEQ ID NO: 527 - RNA, 20 nt, Artificial Sequence
  Antisense Sequence
uggugccucagacggcuuac

SEQ ID NO: 528 - RNA, 20 nt, Artificial Sequence
  Antisense Sequence
guggugccucagacggcuua

SEQ ID NO: 529 - RNA, 20 nt, Artificial Sequence
  Antisense Sequence
agcaaaguggagguaucuau

SEQ ID NO: 530 - RNA, 20 nt, Artificial Sequence
  Antisense Sequence
gucagcaaaguggagguauc

SEQ ID NO: 531 - RNA, 20 nt, Artificial Sequence
  Antisense Sequence
ggucagcaaaguggagguau

SEQ ID NO: 532 - RNA, 20 nt, Artificial Sequence
  Antisense Sequence
uuggucagcaaaguggaggu

SEQ ID NO: 533 - RNA, 20 nt, Artificial Sequence
  Antisense Sequence
auuggucagcaaaguggagg

SEQ ID NO: 534 - RNA, 20 nt, Artificial Sequence
  Antisense Sequence
cauuggucagcaaaguggag

SEQ ID NO: 535 - RNA, 20 nt, Artificial Sequence
  Antisense Sequence
acauuggucagcaaagugga

SEQ ID NO: 536 - RNA, 20 nt, Artificial Sequence
  Antisense Sequence
aacauuggucagcaaagugg

SEQ ID NO: 537 - RNA, 20 nt, Artificial Sequence
  Antisense Sequence
uggaacauuggucagcaaag

SEQ ID NO: 538 - RNA, 20 nt, Artificial Sequence
  Antisense Sequence
ucuggaacauuggucagcaa

SEQ ID NO: 539 - RNA, 20 nt, Artificial Sequence
  Antisense Sequence
ggucuggaacauuggucagc

SEQ ID NO: 540 - RNA, 20 nt, Artificial Sequence
  Antisense Sequence
gggucuggaacauuggucag

SEQ ID NO: 541 - RNA, 20 nt, Artificial Sequence
  Antisense Sequence
cgggucuggaacauugguca

SEQ ID NO: 542 - RNA, 20 nt, Artificial Sequence
  Antisense Sequence
ucgggucuggaacauugguc

SEQ ID NO: 543 - RNA, 20 nt, Artificial Sequence
  Antisense Sequence
cucgggucuggaacauuggu

SEQ ID NO: 544 - RNA, 20 nt, Artificial Sequence
  Antisense Sequence
ggaaaugacagcccucuacc

SEQ ID NO: 545 - RNA, 20 nt, Artificial Sequence
  Antisense Sequence
gggaaaugacagcccucuac

SEQ ID NO: 546 - RNA, 20 nt, Artificial Sequence
  Antisense Sequence
ugggaaaugacagcccucua

SEQ ID NO: 547 - RNA, 20 nt, Artificial Sequence
  Antisense Sequence
gguugggcugggaaaugaca

SEQ ID NO: 548 - RNA, 20 nt, Artificial Sequence
  Antisense Sequence
uugguugggcugggaaauga

SEQ ID NO: 549 - RNA, 20 nt, Artificial Sequence
  Antisense Sequence
uguugguugggcugggaaau

SEQ ID NO: 550 - RNA, 20 nt, Artificial Sequence
  Antisense Sequence
ucuguugguugggcugggaa

SEQ ID NO: 551 - RNA, 20 nt, Artificial Sequence
  Antisense Sequence
auucuguugguugggcuggg

SEQ ID NO: 552 - RNA, 20 nt, Artificial Sequence
  Antisense Sequence
cucccagcaaccauucuguu

SEQ ID NO: 553 - RNA, 20 nt, Artificial Sequence
  Antisense Sequence
gcucccagcaaccauucugu

SEQ ID NO: 554 - RNA, 20 nt, Artificial Sequence
  Antisense Sequence
agcucccagcaaccauucug

SEQ ID NO: 555 - RNA, 20 nt, Artificial Sequence
  Antisense Sequence
agcucuguccaguguucucc

SEQ ID NO: 556 - RNA, 20 nt, Artificial Sequence
  Antisense Sequence
cuguccacccugcauuucuc

SEQ ID NO: 557 - RNA, 20 nt, Artificial Sequence
  Antisense Sequence
auuagacccuccuguccacc

SEQ ID NO: 558 - RNA, 20 nt, Artificial Sequence
  Antisense Sequence
gauuagacccuccuguccac

SEQ ID NO: 559 - RNA, 20 nt, Artificial Sequence
  Antisense Sequence
cgauuagacccuccugucca

SEQ ID NO: 560 - RNA, 20 nt, Artificial Sequence
  Antisense Sequence
acgauuagacccuccugucc

SEQ ID NO: 561 - RNA, 20 nt, Artificial Sequence
  Antisense Sequence
gacgauuagacccuccuguc

SEQ ID NO: 562 - RNA, 20 nt, Artificial Sequence
  Antisense Sequence
agacgauuagacccuccugu

SEQ ID NO: 563 - RNA, 20 nt, Artificial Sequence
  Antisense Sequence
gagacgauuagacccuccug

SEQ ID NO: 564 - RNA, 20 nt, Artificial Sequence
  Antisense Sequence
ugagacgauuagacccuccu

SEQ ID NO: 565 - RNA, 20 nt, Artificial Sequence
  Antisense Sequence
cugagacgauuagacccucc

SEQ ID NO: 566 - RNA, 20 nt, Artificial Sequence
  Antisense Sequence
acugagacgauuagacccuc

SEQ ID NO: 567 - RNA, 20 nt, Artificial Sequence
  Antisense Sequence
cacugagacgauuagacccu

SEQ ID NO: 568 - RNA, 20 nt, Artificial Sequence
  Antisense Sequence
gcacugagacgauuagaccc

SEQ ID NO: 569 - RNA, 20 nt, Artificial Sequence
  Antisense Sequence
cgcacugagacgauuagacc

SEQ ID NO: 570 - RNA, 20 nt, Artificial Sequence
  Antisense Sequence
gcgcacugagacgauuagac

SEQ ID NO: 571 - RNA, 20 nt, Artificial Sequence
  Antisense Sequence
ggcgcacugagacgauuaga

SEQ ID NO: 572 - RNA, 20 nt, Artificial Sequence
  Antisense Sequence
accucagggcacucuuuggu

SEQ ID NO: 573 - RNA, 20 nt, Artificial Sequence
  Antisense Sequence
aaccucagggcacucuuugg

SEQ ID NO: 574 - RNA, 20 nt, Artificial Sequence
  Antisense Sequence
gaaccucagggcacucuuug

SEQ ID NO: 575 - RNA, 20 nt, Artificial Sequence
  Antisense Sequence
agaaccucagggcacucuuu

SEQ ID NO: 576 - RNA, 20 nt, Artificial Sequence
  Antisense Sequence
uagaaccucagggcacucuu

SEQ ID NO: 577 - RNA, 20 nt, Artificial Sequence
  Antisense Sequence
cuagaaccucagggcacucu

SEQ ID NO: 578 - RNA, 20 nt, Artificial Sequence
  Antisense Sequence
ccuagaaccucagggcacuc

SEQ ID NO: 579 - RNA, 20 nt, Artificial Sequence
  Antisense Sequence
uccuagaaccucagggcacu

SEQ ID NO: 580 - RNA, 20 nt, Artificial Sequence
  Antisense Sequence
gcucuuccuagaaccucagg

SEQ ID NO: 581 - RNA, 20 nt, Artificial Sequence
  Antisense Sequence
ccaggcucuuccuagaaccu

SEQ ID NO: 582 - RNA, 20 nt, Artificial Sequence
  Antisense Sequence
accaggcucuuccuagaacc

SEQ ID NO: 583 - RNA, 20 nt, Artificial Sequence
  Antisense Sequence
uaccaggcucuuccuagaac

SEQ ID NO: 584 - RNA, 20 nt, Artificial Sequence
  Antisense Sequence
guaccaggcucuuccuagaa

SEQ ID NO: 585 - RNA, 20 nt, Artificial Sequence
  Antisense Sequence
uguaccaggcucuuccuaga

SEQ ID NO: 586 - RNA, 20 nt, Artificial Sequence
  Antisense Sequence
auguaccaggcucuuccuag

SEQ ID NO: 587 - RNA, 20 nt, Artificial Sequence
  Antisense Sequence
ugauguaccaggcucuuccu

SEQ ID NO: 588 - RNA, 20 nt, Artificial Sequence
  Antisense Sequence
ggugauguaccaggcucuuc

SEQ ID NO: 589 - RNA, 20 nt, Artificial Sequence
  Antisense Sequence
auggagcuuggugauguacc

SEQ ID NO: 590 - RNA, 20 nt, Artificial Sequence
  Antisense Sequence
uggcaauggagcuuggugau

SEQ ID NO: 591 - RNA, 20 nt, Artificial Sequence
  Antisense Sequence
guggcaauggagcuugguga

SEQ ID NO: 592 - RNA, 20 nt, Artificial Sequence
  Antisense Sequence
cguggcaauggagcuuggug

SEQ ID NO: 593 - RNA, 20 nt, Artificial Sequence
  Antisense Sequence
acguggcaauggagcuuggu

SEQ ID NO: 594 - RNA, 20 nt, Artificial Sequence
  Antisense Sequence
accuuugguuuuggaccuca

SEQ ID NO: 595 - RNA, 20 nt, Artificial Sequence
  Antisense Sequence
uaccuuugguuuuggaccuc

SEQ ID NO: 596 - RNA, 20 nt, Artificial Sequence
  Antisense Sequence
cuaccuuugguuuuggaccu

SEQ ID NO: 597 - RNA, 20 nt, Artificial Sequence
  Antisense Sequence
gcuaccuuugguuuuggacc

SEQ ID NO: 598 - RNA, 20 nt, Artificial Sequence
  Antisense Sequence
acugcuaccuuugguuuugg

SEQ ID NO: 599 - RNA, 20 nt, Artificial Sequence
  Antisense Sequence
cacugcuaccuuugguuuug

SEQ ID NO: 600 - RNA, 20 nt, Artificial Sequence
  Antisense Sequence
ucacugcuaccuuugguuuu

SEQ ID NO: 601 - RNA, 20 nt, Artificial Sequence
  Antisense Sequence
aucacugcuaccuuugguuu

SEQ ID NO: 602 - RNA, 20 nt, Artificial Sequence
  Antisense Sequence
gagagacugucuucaggauc

SEQ ID NO: 603 - RNA, 20 nt, Artificial Sequence
  Antisense Sequence
acacugccagagaagagaga

SEQ ID NO: 604 - RNA, 20 nt, Artificial Sequence
  Antisense Sequence
cacacugccagagaagagag

SEQ ID NO: 605 - RNA, 20 nt, Artificial Sequence
  Antisense Sequence
agcugguuccuuuguucuuu

SEQ ID NO: 606 - RNA, 20 nt, Artificial Sequence
  Antisense Sequence
gggacaagcugguuccuuug

SEQ ID NO: 607 - RNA, 20 nt, Artificial Sequence
  Antisense Sequence
agggacaagcugguuccuuu

SEQ ID NO: 608 - RNA, 20 nt, Artificial Sequence
  Antisense Sequence
cagggacaagcugguuccuu

SEQ ID NO: 609 - RNA, 20 nt, Artificial Sequence
  Antisense Sequence
gacagggacaagcugguucc

SEQ ID NO: 610 - RNA, 20 nt, Artificial Sequence
  Antisense Sequence
agacagggacaagcugguuc

SEQ ID NO: 611 - RNA, 20 nt, Artificial Sequence
  Antisense Sequence
aagagacagggacaagcugg

SEQ ID NO: 612 - RNA, 20 nt, Artificial Sequence
  Antisense Sequence
caagagacagggacaagcug

SEQ ID NO: 613 - RNA, 20 nt, Artificial Sequence
  Antisense Sequence
acaagagacagggacaagcu

SEQ ID NO: 614 - RNA, 20 nt, Artificial Sequence
  Antisense Sequence
auggagugaugaggagugcc

SEQ ID NO: 615 - RNA, 20 nt, Artificial Sequence
  Antisense Sequence
cuggcuuguagcuggcugga

SEQ ID NO: 616 - RNA, 20 nt, Artificial Sequence
  Antisense Sequence
ccaccaguguccaccaugug

SEQ ID NO: 617 - RNA, 20 nt, Artificial Sequence
  Antisense Sequence
aguaccaccaguguccacca

SEQ ID NO: 618 - RNA, 20 nt, Artificial Sequence
  Antisense Sequence
caguaccaccaguguccacc

SEQ ID NO: 619 - RNA, 20 nt, Artificial Sequence
  Antisense Sequence
ccucaguaccaccagugucc

SEQ ID NO: 620 - RNA, 20 nt, Artificial Sequence
  Antisense Sequence
gaccucaguaccaccagugu

SEQ ID NO: 621 - RNA, 20 nt, Artificial Sequence
  Antisense Sequence
uggaccucaguaccaccagu

SEQ ID NO: 622 - RNA, 20 nt, Artificial Sequence
  Antisense Sequence
gcuggaccucaguaccacca

SEQ ID NO: 623 - RNA, 20 nt, Artificial Sequence
  Antisense Sequence
aaggcuggaccucaguacca

SEQ ID NO: 624 - RNA, 20 nt, Artificial Sequence
  Antisense Sequence
gaaggcuggaccucaguacc

SEQ ID NO: 625 - RNA, 20 nt, Artificial Sequence
  Antisense Sequence
ggaaggcuggaccucaguac

SEQ ID NO: 626 - RNA, 20 nt, Artificial Sequence
  Antisense Sequence
uuggaaggcuggaccucagu

SEQ ID NO: 627 - RNA, 20 nt, Artificial Sequence
  Antisense Sequence
auuggaaggcuggaccucag

SEQ ID NO: 628 - RNA, 20 nt, Artificial Sequence
  Antisense Sequence
aauuggaaggcuggaccuca

SEQ ID NO: 629 - RNA, 20 nt, Artificial Sequence
  Antisense Sequence
cuaauuggaaggcuggaccu

SEQ ID NO: 630 - RNA, 20 nt, Artificial Sequence
  Antisense Sequence
ccuaauuggaaggcuggacc

SEQ ID NO: 631 - RNA, 20 nt, Artificial Sequence
  Antisense Sequence
uccuaauuggaaggcuggac

SEQ ID NO: 632 - RNA, 20 nt, Artificial Sequence
  Antisense Sequence
cugucaagagagacuauuag

SEQ ID NO: 633 - RNA, 20 nt, Artificial Sequence
  Antisense Sequence
gcugucaagagagacuauua

SEQ ID NO: 634 - RNA, 20 nt, Artificial Sequence
  Antisense Sequence
ggcugucaagagagacuauu

SEQ ID NO: 635 - RNA, 20 nt, Artificial Sequence
  Antisense Sequence
gggcugucaagagagacuau

SEQ ID NO: 636 - RNA, 20 nt, Artificial Sequence
  Antisense Sequence
cccucuguuuagaugauggg

SEQ ID NO: 637 - RNA, 20 nt, Artificial Sequence
  Antisense Sequence
cuccacuuugcucaucuccc

SEQ ID NO: 638 - RNA, 20 nt, Artificial Sequence
  Antisense Sequence
uacuccacuuugcucaucuc

SEQ ID NO: 639 - RNA, 20 nt, Artificial Sequence
  Antisense Sequence
uuacuccacuuugcucaucu

SEQ ID NO: 640 - RNA, 20 nt, Artificial Sequence
  Antisense Sequence
uuuacuccacuuugcucauc

SEQ ID NO: 641 - RNA, 20 nt, Artificial Sequence
  Antisense Sequence
cuuuacuccacuuugcucau

SEQ ID NO: 642 - RNA, 20 nt, Artificial Sequence
  Antisense Sequence
ucuuuacuccacuuugcuca

SEQ ID NO: 643 - RNA, 20 nt, Artificial Sequence
  Antisense Sequence
gucuuuacuccacuuugcuc

SEQ ID NO: 644 - RNA, 20 nt, Artificial Sequence
  Antisense Sequence
gaaaugugucuuuacuccac

SEQ ID NO: 645 - RNA, 20 nt, Artificial Sequence
  Antisense Sequence
gugugauuuggaaauguguc

SEQ ID NO: 646 - RNA, 20 nt, Artificial Sequence
  Antisense Sequence
gugggugugauuuggaaaug

SEQ ID NO: 647 - RNA, 20 nt, Artificial Sequence
  Antisense Sequence
agugggugugauuuggaaau

SEQ ID NO: 648 - RNA, 20 nt, Artificial Sequence
  Antisense Sequence
gaaggugggccucaugcuag

SEQ ID NO: 649 - RNA, 20 nt, Artificial Sequence
  Antisense Sequence
caccacacccaguccucacu

SEQ ID NO: 650 - RNA, 20 nt, Artificial Sequence
  Antisense Sequence
augagccaccacacccaguc

SEQ ID NO: 651 - RNA, 20 nt, Artificial Sequence
  Antisense Sequence
caugagccaccacacccagu

SEQ ID NO: 652 - RNA, 20 nt, Artificial Sequence
  Antisense Sequence
acaugagccaccacacccag

SEQ ID NO: 653 - RNA, 20 nt, Artificial Sequence
  Antisense Sequence
gacaugagccaccacaccca

SEQ ID NO: 654 - RNA, 20 nt, Artificial Sequence
  Antisense Sequence
agacaugagccaccacaccc

SEQ ID NO: 655 - RNA, 20 nt, Artificial Sequence
  Antisense Sequence
uagacaugagccaccacacc

SEQ ID NO: 656 - RNA, 20 nt, Artificial Sequence
  Antisense Sequence
auagacaugagccaccacac

SEQ ID NO: 657 - RNA, 20 nt, Artificial Sequence
  Antisense Sequence
gcucaagcgauccucucacc

SEQ ID NO: 658 - RNA, 20 nt, Artificial Sequence
  Antisense Sequence
ggcucaagcgauccucucac

SEQ ID NO: 659 - RNA, 20 nt, Artificial Sequence
  Antisense Sequence
gggcucaagcgauccucuca

SEQ ID NO: 660 - RNA, 20 nt, Artificial Sequence
  Antisense Sequence
ugggcucaagcgauccucuc

SEQ ID NO: 661 - RNA, 20 nt, Artificial Sequence
  Antisense Sequence
cugggcucaagcgauccucu

SEQ ID NO: 662 - RNA, 20 nt, Artificial Sequence
  Antisense Sequence
ucuuuuguagagacaggguc

SEQ ID NO: 663 - RNA, 20 nt, Artificial Sequence
  Antisense Sequence
uucuuuuguagagacagggu

SEQ ID NO: 664 - RNA, 20 nt, Artificial Sequence
  Antisense Sequence
auucuuuuguagagacaggg

SEQ ID NO: 665 - RNA, 20 nt, Artificial Sequence
  Antisense Sequence
acaccacacaggcuaauuua

SEQ ID NO: 666 - RNA, 20 nt, Artificial Sequence
  Antisense Sequence
ugccaccacaccaaccacac

SEQ ID NO: 667 - RNA, 20 nt, Artificial Sequence
  Antisense Sequence
gugccaccacaccaaccaca

SEQ ID NO: 668 - RNA, 20 nt, Artificial Sequence
  Antisense Sequence
gcuaagucuacaggugcgug

SEQ ID NO: 669 - RNA, 20 nt, Artificial Sequence
  Antisense Sequence
uugaccuccuggguuaagug

SEQ ID NO: 670 - RNA, 20 nt, Artificial Sequence
  Antisense Sequence
cuugaccuccuggguuaagu

SEQ ID NO: 671 - RNA, 20 nt, Artificial Sequence
  Antisense Sequence
gccuugaccuccuggguuaa

SEQ ID NO: 672 - RNA, 20 nt, Artificial Sequence
  Antisense Sequence
uacaggcaugagccaccgca

SEQ ID NO: 673 - RNA, 20 nt, Artificial Sequence
  Antisense Sequence
uuacaggcaugagccaccgc

SEQ ID NO: 674 - RNA, 20 nt, Artificial Sequence
  Antisense Sequence
auuacaggcaugagccaccg

SEQ ID NO: 675 - RNA, 20 nt, Artificial Sequence
  Antisense Sequence
gauuacaggcaugagccacc

SEQ ID NO: 676 - RNA, 20 nt, Artificial Sequence
  Antisense Sequence
ggauuacaggcaugagccac

SEQ ID NO: 677 - RNA, 20 nt, Artificial Sequence
  Antisense Sequence
gggauuacaggcaugagcca

SEQ ID NO: 678 - RNA, 20 nt, Artificial Sequence
  Antisense Sequence
ugggauuacaggcaugagcc

SEQ ID NO: 679 - RNA, 20 nt, Artificial Sequence
  Antisense Sequence
cugggauuacaggcaugagc

SEQ ID NO: 680 - RNA, 20 nt, Artificial Sequence
  Antisense Sequence
gcugggauuacaggcaugag

SEQ ID NO: 681 - RNA, 20 nt, Artificial Sequence
  Antisense Sequence
ugcugggauuacaggcauga

SEQ ID NO: 682 - RNA, 20 nt, Artificial Sequence
  Antisense Sequence
gugcugggauuacaggcaug

SEQ ID NO: 683 - RNA, 20 nt, Artificial Sequence
  Antisense Sequence
agugcugggauuacaggcau

SEQ ID NO: 684 - RNA, 20 nt, Artificial Sequence
  Antisense Sequence
aagugcugggauuacaggca

SEQ ID NO: 685 - RNA, 20 nt, Artificial Sequence
  Antisense Sequence
aaagugcugggauuacaggc

SEQ ID NO: 686 - RNA, 20 nt, Artificial Sequence
  Antisense Sequence
caaagugcugggauuacagg

SEQ ID NO: 687 - RNA, 20 nt, Artificial Sequence
  Antisense Sequence
ccaaagugcugggauuacag

SEQ ID NO: 688 - RNA, 20 nt, Artificial Sequence
  Antisense Sequence
guuagccaggauggucucca

SEQ ID NO: 689 - RNA, 20 nt, Artificial Sequence
  Antisense Sequence
uguuagccaggauggucucc

SEQ ID NO: 690 - RNA, 20 nt, Artificial Sequence
  Antisense Sequence
guguuagccaggauggucuc

SEQ ID NO: 691 - RNA, 20 nt, Artificial Sequence
  Antisense Sequence
uguguuagccaggauggucu

SEQ ID NO: 692 - RNA, 20 nt, Artificial Sequence
  Antisense Sequence
cuguguuagccaggaugguc

SEQ ID NO: 693 - RNA, 20 nt, Artificial Sequence
  Antisense Sequence
acuguguuagccaggauggu

SEQ ID NO: 694 - RNA, 20 nt, Artificial Sequence
  Antisense Sequence
cacuguguuagccaggaugg

SEQ ID NO: 695 - RNA, 20 nt, Artificial Sequence
  Antisense Sequence
ucacuguguuagccaggaug

SEQ ID NO: 696 - RNA, 20 nt, Artificial Sequence
  Antisense Sequence
uucacuguguuagccaggau

SEQ ID NO: 697 - RNA, 20 nt, Artificial Sequence
  Antisense Sequence
uuucacuguguuagccagga

SEQ ID NO: 698 - RNA, 20 nt, Artificial Sequence
  Antisense Sequence
guuucacuguguuagccagg

SEQ ID NO: 699 - RNA, 20 nt, Artificial Sequence
  Antisense Sequence
gguuucacuguguuagccag

SEQ ID NO: 700 - RNA, 20 nt, Artificial Sequence
  Antisense Sequence
ggguuucacuguguuagcca

SEQ ID NO: 701 - RNA, 20 nt, Artificial Sequence
  Antisense Sequence
uucuucugccucagccuccc

SEQ ID NO: 702 - RNA, 20 nt, Artificial Sequence
  Antisense Sequence
auucuucugccucagccucc

SEQ ID NO: 703 - RNA, 20 nt, Artificial Sequence
  Antisense Sequence
cauucuucugccucagccuc

SEQ ID NO: 704 - RNA, 20 nt, Artificial Sequence
  Antisense Sequence
ccauucuucugccucagccu

SEQ ID NO: 705 - RNA, 20 nt, Artificial Sequence
  Antisense Sequence
accauucuucugccucagcc

SEQ ID NO: 706 - RNA, 20 nt, Artificial Sequence
  Antisense Sequence
caccauucuucugccucagc

SEQ ID NO: 707 - RNA, 20 nt, Artificial Sequence
  Antisense Sequence
acaccauucuucugccucag

SEQ ID NO: 708 - RNA, 20 nt, Artificial Sequence
  Antisense Sequence
cucacugcaagcuccaccuc

SEQ ID NO: 709 - RNA, 20 nt, Artificial Sequence
  Antisense Sequence
gcucacugcaagcuccaccu

SEQ ID NO: 710 - RNA, 20 nt, Artificial Sequence
  Antisense Sequence
ucggcucacugcaagcucca

SEQ ID NO: 711 - RNA, 20 nt, Artificial Sequence
  Antisense Sequence
ucucggcucacugcaagcuc

SEQ ID NO: 712 - RNA, 20 nt, Artificial Sequence
  Antisense Sequence
aucucggcucacugcaagcu

SEQ ID NO: 713 - RNA, 20 nt, Artificial Sequence
  Antisense Sequence
aaucucggcucacugcaagc

SEQ ID NO: 714 - RNA, 20 nt, Artificial Sequence
  Antisense Sequence
caaucucggcucacugcaag

SEQ ID NO: 715 - RNA, 20 nt, Artificial Sequence
  Antisense Sequence
acaaucucggcucacugcaa

SEQ ID NO: 716 - RNA, 20 nt, Artificial Sequence
  Antisense Sequence
cacaaucucggcucacugca

SEQ ID NO: 717 - RNA, 20 nt, Artificial Sequence
  Antisense Sequence
gcacaaucucggcucacugc

SEQ ID NO: 718 - RNA, 20 nt, Artificial Sequence
  Antisense Sequence
ggcacaaucucggcucacug

SEQ ID NO: 719 - RNA, 20 nt, Artificial Sequence
  Antisense Sequence
uggcacaaucucggcucacu

SEQ ID NO: 720 - RNA, 20 nt, Artificial Sequence
  Antisense Sequence
guggcacaaucucggcucac

SEQ ID NO: 721 - RNA, 20 nt, Artificial Sequence
  Antisense Sequence
aguggcacaaucucggcuca

SEQ ID NO: 722 - RNA, 20 nt, Artificial Sequence
  Antisense Sequence
caguggcacaaucucggcuc

SEQ ID NO: 723 - RNA, 20 nt, Artificial Sequence
  Antisense Sequence
gcaguggcacaaucucggcu

SEQ ID NO: 724 - RNA, 20 nt, Artificial Sequence
  Antisense Sequence
ugcaguggcacaaucucggc

SEQ ID NO: 725 - RNA, 20 nt, Artificial Sequence
  Antisense Sequence
aggcugagucucgcucuguc

SEQ ID NO: 726 - RNA, 20 nt, Artificial Sequence
  Antisense Sequence
ccacauuuucucacugucuu

SEQ ID NO: 727 - RNA, 20 nt, Artificial Sequence
  Antisense Sequence
cuccugaccacauuuucuca

SEQ ID NO: 728 - RNA, 20 nt, Artificial Sequence
  Antisense Sequence
ccuccugaccacauuuucuc

SEQ ID NO: 729 - RNA, 20 nt, Artificial Sequence
  Antisense Sequence
cccuccugaccacauuuucu

SEQ ID NO: 730 - RNA, 20 nt, Artificial Sequence
  Antisense Sequence
gcccuccugaccacauuuuc

SEQ ID NO: 731 - RNA, 20 nt, Artificial Sequence
  Antisense Sequence
ucuugguucccagucucagc

SEQ ID NO: 732 - RNA, 20 nt, Artificial Sequence
  Antisense Sequence
gcagucuugguucccagucu

SEQ ID NO: 733 - RNA, 20 nt, Artificial Sequence
  Antisense Sequence
cagcagucuugguucccagu

SEQ ID NO: 734 - RNA, 20 nt, Artificial Sequence
  Antisense Sequence
uacagcagucuugguuccca

SEQ ID NO: 735 - RNA, 20 nt, Artificial Sequence
  Antisense Sequence
auacagcagucuugguuccc

SEQ ID NO: 736 - RNA, 20 nt, Artificial Sequence
  Antisense Sequence
caaauacagcagucuugguu

SEQ ID NO: 737 - RNA, 20 nt, Artificial Sequence
  Antisense Sequence
gcaaauacagcagucuuggu

SEQ ID NO: 738 - RNA, 20 nt, Artificial Sequence
  Antisense Sequence
ggcaaauacagcagucuugg

SEQ ID NO: 739 - RNA, 20 nt, Artificial Sequence
  Antisense Sequence
aaggcaaauacagcagucuu

SEQ ID NO: 740 - RNA, 20 nt, Artificial Sequence
  Antisense Sequence
caaggcaaauacagcagucu

SEQ ID NO: 741 - RNA, 20 nt, Artificial Sequence
  Antisense Sequence
gcaaggcaaauacagcaguc

SEQ ID NO: 742 - RNA, 20 nt, Artificial Sequence
  Antisense Sequence
agcaaggcaaauacagcagu

SEQ ID NO: 743 - RNA, 20 nt, Artificial Sequence
  Antisense Sequence
aaagcaaggcaaauacagca

SEQ ID NO: 744 - RNA, 20 nt, Artificial Sequence
  Antisense Sequence
caaagcaaggcaaauacagc

SEQ ID NO: 745 - RNA, 20 nt, Artificial Sequence
  Antisense Sequence
uugacaacaaagcaaggcaa

SEQ ID NO: 746 - RNA, 20 nt, Artificial Sequence
  Antisense Sequence
cucuaagagcuuuugacaac

SEQ ID NO: 747 - RNA, 20 nt, Artificial Sequence
  Antisense Sequence
uugccucagccuccuaaagu

SEQ ID NO: 748 - RNA, 20 nt, Artificial Sequence
  Antisense Sequence
cuugccucagccuccuaaag

SEQ ID NO: 749 - RNA, 20 nt, Artificial Sequence
  Antisense Sequence
acuugccucagccuccuaaa

SEQ ID NO: 750 - RNA, 20 nt, Artificial Sequence
  Antisense Sequence
cacuugccucagccuccuaa

SEQ ID NO: 751 - RNA, 20 nt, Artificial Sequence
  Antisense Sequence
ccacuugccucagccuccua

SEQ ID NO: 752 - RNA, 20 nt, Artificial Sequence
  Antisense Sequence
uccacuugccucagccuccu

SEQ ID NO: 753 - RNA, 20 nt, Artificial Sequence
  Antisense Sequence
auccacuugccucagccucc

SEQ ID NO: 754 - RNA, 20 nt, Artificial Sequence
  Antisense Sequence
ugggcucaagcaauccacuu

SEQ ID NO: 755 - RNA, 20 nt, Artificial Sequence
  Antisense Sequence
cugggcucaagcaauccacu

SEQ ID NO: 756 - RNA, 20 nt, Artificial Sequence
  Antisense Sequence
ccugggcucaagcaauccac

SEQ ID NO: 757 - RNA, 20 nt, Artificial Sequence
  Antisense Sequence
uccugggcucaagcaaucca

SEQ ID NO: 758 - RNA, 20 nt, Artificial Sequence
  Antisense Sequence
cuccugggcucaagcaaucc

SEQ ID NO: 759 - RNA, 20 nt, Artificial Sequence
  Antisense Sequence
acuccugggcucaagcaauc

SEQ ID NO: 760 - RNA, 20 nt, Artificial Sequence
  Antisense Sequence
aacuccugggcucaagcaau

SEQ ID NO: 761 - RNA, 20 nt, Artificial Sequence
  Antisense Sequence
gaacuccugggcucaagcaa

SEQ ID NO: 762 - RNA, 20 nt, Artificial Sequence
  Antisense Sequence
ugaacuccugggcucaagca

SEQ ID NO: 763 - RNA, 20 nt, Artificial Sequence
  Antisense Sequence
gucuugaacuccugggcuca

SEQ ID NO: 764 - RNA, 20 nt, Artificial Sequence
  Antisense Sequence
ggucuugaacuccugggcuc

SEQ ID NO: 765 - RNA, 20 nt, Artificial Sequence
  Antisense Sequence
uggucuugaacuccugggcu

SEQ ID NO: 766 - RNA, 20 nt, Artificial Sequence
  Antisense Sequence
cuggucuugaacuccugggc

SEQ ID NO: 767 - RNA, 20 nt, Artificial Sequence
  Antisense Sequence
gcuggucuugaacuccuggg

SEQ ID NO: 768 - RNA, 20 nt, Artificial Sequence
  Antisense Sequence
ggcuggucuugaacuccugg

SEQ ID NO: 769 - RNA, 20 nt, Artificial Sequence
  Antisense Sequence
aggcuggucuugaacuccug

SEQ ID NO: 770 - RNA, 20 nt, Artificial Sequence
  Antisense Sequence
caggcuggucuugaacuccu

SEQ ID NO: 771 - RNA, 20 nt, Artificial Sequence
  Antisense Sequence
ccaggcuggucuugaacucc

SEQ ID NO: 772 - RNA, 20 nt, Artificial Sequence
  Antisense Sequence
auuucccacagagacagggu

SEQ ID NO: 773 - RNA, 20 nt, Artificial Sequence
  Antisense Sequence
caccacaccuggcuaauuuu

SEQ ID NO: 774 - RNA, 20 nt, Artificial Sequence
  Antisense Sequence
ccaccacaccuggcuaauuu

SEQ ID NO: 775 - RNA, 20 nt, Artificial Sequence
  Antisense Sequence
accaccacaccuggcuaauu

SEQ ID NO: 776 - RNA, 20 nt, Artificial Sequence
  Antisense Sequence
caccaccacaccuggcuaau

SEQ ID NO: 777 - RNA, 20 nt, Artificial Sequence
  Antisense Sequence
gcaccaccacaccuggcuaa

SEQ ID NO: 778 - RNA, 20 nt, Artificial Sequence
  Antisense Sequence
aguugggacuacaggugcgc

SEQ ID NO: 779 - RNA, 20 nt, Artificial Sequence
  Antisense Sequence
cugccucagccuccuuagua

SEQ ID NO: 780 - RNA, 20 nt, Artificial Sequence
  Antisense Sequence
ucugccucagccuccuuagu

SEQ ID NO: 781 - RNA, 20 nt, Artificial Sequence
  Antisense Sequence
uucugccucagccuccuuag

SEQ ID NO: 782 - RNA, 20 nt, Artificial Sequence
  Antisense Sequence
cuucugccucagccuccuua

SEQ ID NO: 783 - RNA, 20 nt, Artificial Sequence
  Antisense Sequence
ccuucugccucagccuccuu

SEQ ID NO: 784 - RNA, 20 nt, Artificial Sequence
  Antisense Sequence
uccuucugccucagccuccu

SEQ ID NO: 785 - RNA, 20 nt, Artificial Sequence
  Antisense Sequence
auccuucugccucagccucc

SEQ ID NO: 786 - RNA, 20 nt, Artificial Sequence
  Antisense Sequence
aauccuucugccucagccuc

SEQ ID NO: 787 - RNA, 20 nt, Artificial Sequence
  Antisense Sequence
caauccuucugccucagccu

SEQ ID NO: 788 - RNA, 20 nt, Artificial Sequence
  Antisense Sequence
cacaaucauagcucacugca

SEQ ID NO: 789 - RNA, 20 nt, Artificial Sequence
  Antisense Sequence
gcacaaucauagcucacugc

SEQ ID NO: 790 - RNA, 20 nt, Artificial Sequence
  Antisense Sequence
cucaaucuguuguucaggcu

SEQ ID NO: 791 - RNA, 20 nt, Artificial Sequence
  Antisense Sequence
ucucaaucuguuguucaggc

SEQ ID NO: 792 - RNA, 20 nt, Artificial Sequence
  Antisense Sequence
gucucaaucuguuguucagg

SEQ ID NO: 793 - RNA, 20 nt, Artificial Sequence
  Antisense Sequence
ggucucaaucuguuguucag

SEQ ID NO: 794 - RNA, 20 nt, Artificial Sequence
  Antisense Sequence
ccuagaaguagugccaggcc

SEQ ID NO: 795 - RNA, 20 nt, Artificial Sequence
  Antisense Sequence
uccuagaaguagugccaggc

SEQ ID NO: 796 - RNA, 20 nt, Artificial Sequence
  Antisense Sequence
auccuagaaguagugccagg

SEQ ID NO: 797 - RNA, 20 nt, Artificial Sequence
  Antisense Sequence
gcauccuagaaguagugcca

SEQ ID NO: 798 - RNA, 20 nt, Artificial Sequence
  Antisense Sequence
gacugugagaguugccuaaa

SEQ ID NO: 799 - RNA, 20 nt, Artificial Sequence
  Antisense Sequence
gggacugugagaguugccua

SEQ ID NO: 800 - RNA, 20 nt, Artificial Sequence
  Antisense Sequence
agggacugugagaguugccu

SEQ ID NO: 801 - RNA, 20 nt, Artificial Sequence
  Antisense Sequence
aagggacugugagaguugcc

SEQ ID NO: 802 - RNA, 20 nt, Artificial Sequence
  Antisense Sequence
caagggacugugagaguugc

SEQ ID NO: 803 - RNA, 20 nt, Artificial Sequence
  Antisense Sequence
ucaagggacugugagaguug

SEQ ID NO: 804 - RNA, 20 nt, Artificial Sequence
  Antisense Sequence
uucaagggacugugagaguu

SEQ ID NO: 805 - RNA, 20 nt, Artificial Sequence
  Antisense Sequence
cuuucaagggacugugagag

SEQ ID NO: 806 - RNA, 20 nt, Artificial Sequence
  Antisense Sequence
ucuuucaagggacugugaga

SEQ ID NO: 807 - RNA, 20 nt, Artificial Sequence
  Antisense Sequence
cucuuucaagggacugugag

SEQ ID NO: 808 - RNA, 20 nt, Artificial Sequence
  Antisense Sequence
ucucuuucaagggacuguga

SEQ ID NO: 809 - RNA, 20 nt, Artificial Sequence
  Antisense Sequence
cuucucuuucaagggacugu

SEQ ID NO: 810 - RNA, 20 nt, Artificial Sequence
  Antisense Sequence
acuucucuuucaagggacug

SEQ ID NO: 811 - RNA, 20 nt, Artificial Sequence
  Antisense Sequence
cacuucucuuucaagggacu

SEQ ID NO: 812 - RNA, 20 nt, Artificial Sequence
  Antisense Sequence
ugccacuucucuuucaaggg

SEQ ID NO: 813 - RNA, 20 nt, Artificial Sequence
  Antisense Sequence
acuugggagggccuauaccc

SEQ ID NO: 814 - RNA, 20 nt, Artificial Sequence
  Antisense Sequence
cacuugggagggccuauacc

SEQ ID NO: 815 - RNA, 20 nt, Artificial Sequence
  Antisense Sequence
acacuugggagggccuauac

SEQ ID NO: 816 - RNA, 20 nt, Artificial Sequence
  Antisense Sequence
caugacacuugggagggccu

SEQ ID NO: 817 - RNA, 20 nt, Artificial Sequence
  Antisense Sequence
ucuuacacagggcagagucc

SEQ ID NO: 818 - RNA, 20 nt, Artificial Sequence
  Antisense Sequence
aucuuacacagggcagaguc

SEQ ID NO: 819 - RNA, 20 nt, Artificial Sequence
  Antisense Sequence
aaucuuacacagggcagagu

SEQ ID NO: 820 - RNA, 20 nt, Artificial Sequence
  Antisense Sequence
augcaaucuuacacagggca

SEQ ID NO: 821 - RNA, 20 nt, Artificial Sequence
  Antisense Sequence
gugaugcaaucuuacacagg

SEQ ID NO: 822 - RNA, 20 nt, Artificial Sequence
  Antisense Sequence
ggugaugcaaucuuacacag

SEQ ID NO: 823 - RNA, 20 nt, Artificial Sequence
  Antisense Sequence
uggugaugcaaucuuacaca

SEQ ID NO: 824 - RNA, 20 nt, Artificial Sequence
  Antisense Sequence
guggugaugcaaucuuacac

SEQ ID NO: 825 - RNA, 20 nt, Artificial Sequence
  Antisense Sequence
gguggugaugcaaucuuaca

SEQ ID NO: 826 - RNA, 20 nt, Artificial Sequence
  Antisense Sequence
ugguggugaugcaaucuuac

SEQ ID NO: 827 - RNA, 20 nt, Artificial Sequence
  Antisense Sequence
uggugguggugaugcaaucu

SEQ ID NO: 828 - RNA, 20 nt, Artificial Sequence
  Antisense Sequence
guggugguggugaugcaauc

SEQ ID NO: 829 - RNA, 20 nt, Artificial Sequence
  Antisense Sequence
gugguggugguggugaugca

SEQ ID NO: 830 - RNA, 20 nt, Artificial Sequence
  Antisense Sequence
aggugguggugguggugaug

SEQ ID NO: 831 - RNA, 20 nt, Artificial Sequence
  Antisense Sequence
gaggugguggugguggugau

SEQ ID NO: 832 - RNA, 20 nt, Artificial Sequence
  Antisense Sequence
agagguggugguggugguga

SEQ ID NO: 833 - RNA, 20 nt, Artificial Sequence
  Antisense Sequence
agagaggugguggugguggu

SEQ ID NO: 834 - RNA, 20 nt, Artificial Sequence
  Antisense Sequence
acguguuccugugaugucug

SEQ ID NO: 835 - RNA, 20 nt, Artificial Sequence
  Antisense Sequence
aacguguuccugugaugucu

SEQ ID NO: 836 - RNA, 20 nt, Artificial Sequence
  Antisense Sequence
gaacguguuccugugauguc

SEQ ID NO: 837 - RNA, 20 nt, Artificial Sequence
  Antisense Sequence
ugauguggaggagggccaga

SEQ ID NO: 838 - RNA, 20 nt, Artificial Sequence
  Antisense Sequence
augauguggaggagggccag

SEQ ID NO: 839 - RNA, 20 nt, Artificial Sequence
  Antisense Sequence
caugauguggaggagggcca

SEQ ID NO: 840 - RNA, 20 nt, Artificial Sequence
  Antisense Sequence
ggagcaugauguggaggagg

SEQ ID NO: 841 - RNA, 20 nt, Artificial Sequence
  Antisense Sequence
uggagcaugauguggaggag

SEQ ID NO: 842 - RNA, 20 nt, Artificial Sequence
  Antisense Sequence
guggagcaugauguggagga

SEQ ID NO: 843 - RNA, 20 nt, Artificial Sequence
  Antisense Sequence
uguggagcaugauguggagg

SEQ ID NO: 844 - RNA, 20 nt, Artificial Sequence
  Antisense Sequence
auguggagcaugauguggag

SEQ ID NO: 845 - RNA, 20 nt, Artificial Sequence
  Antisense Sequence
gauguggagcaugaugugga

SEQ ID NO: 846 - RNA, 20 nt, Artificial Sequence
  Antisense Sequence
ugauguggagcaugaugugg

SEQ ID NO: 847 - RNA, 20 nt, Artificial Sequence
  Antisense Sequence
augauguggagcaugaugug

SEQ ID NO: 848 - RNA, 20 nt, Artificial Sequence
  Antisense Sequence
uggagcaugauguggagcau

SEQ ID NO: 849 - RNA, 20 nt, Artificial Sequence
  Antisense Sequence
gccuggagcaugauguggag

SEQ ID NO: 850 - RNA, 20 nt, Artificial Sequence
  Antisense Sequence
ggccuggagcaugaugugga

SEQ ID NO: 851 - RNA, 20 nt, Artificial Sequence
  Antisense Sequence
uggccuggagcaugaugugg

SEQ ID NO: 852 - RNA, 20 nt, Artificial Sequence
  Antisense Sequence
uuggccuggagcaugaugug

SEQ ID NO: 853 - RNA, 20 nt, Artificial Sequence
  Antisense Sequence
guuggccuggagcaugaugu

SEQ ID NO: 854 - RNA, 20 nt, Artificial Sequence
  Antisense Sequence
aguuggccuggagcaugaug

SEQ ID NO: 855 - RNA, 20 nt, Artificial Sequence
  Antisense Sequence
caguuggccuggagcaugau

SEQ ID NO: 856 - RNA, 20 nt, Artificial Sequence
  Antisense Sequence
gccacgaggcacagaaguca

SEQ ID NO: 857 - RNA, 20 nt, Artificial Sequence
  Antisense Sequence
gagaauggagcccucuugcu

SEQ ID NO: 858 - RNA, 20 nt, Artificial Sequence
  Antisense Sequence
gguaggagaauggagcccuc

SEQ ID NO: 859 - RNA, 20 nt, Artificial Sequence
  Antisense Sequence
ggguaggagaauggagcccu

SEQ ID NO: 860 - RNA, 20 nt, Artificial Sequence
  Antisense Sequence
acagggaugaggguuugggc

SEQ ID NO: 861 - RNA, 20 nt, Artificial Sequence
  Antisense Sequence
uaggacagggaugaggguuu

SEQ ID NO: 862 - RNA, 20 nt, Artificial Sequence
  Antisense Sequence
cuaggacagggaugaggguu

SEQ ID NO: 863 - RNA, 20 nt, Artificial Sequence
  Antisense Sequence
uuccaguggguauuccucug

SEQ ID NO: 864 - RNA, 20 nt, Artificial Sequence
  Antisense Sequence
guuccaguggguauuccucu

SEQ ID NO: 865 - RNA, 20 nt, Artificial Sequence
  Antisense Sequence
aguuccaguggguauuccuc

SEQ ID NO: 866 - RNA, 20 nt, Artificial Sequence
  Antisense Sequence
gcaguuuccaugaggcagcu

SEQ ID NO: 867 - RNA, 20 nt, Artificial Sequence
  Antisense Sequence
ugcagcaguuuccaugaggc

SEQ ID NO: 868 - RNA, 20 nt, Artificial Sequence
  Antisense Sequence
cuagcuucaccacugcugca

SEQ ID NO: 869 - RNA, 20 nt, Artificial Sequence
  Antisense Sequence
cuuucuagcuucaccacugc

SEQ ID NO: 870 - RNA, 20 nt, Artificial Sequence
  Antisense Sequence
uagucuuucuagcuucacca

SEQ ID NO: 871 - RNA, 20 nt, Artificial Sequence
  Antisense Sequence
cucauaccucuagucuuucu

SEQ ID NO: 872 - RNA, 20 nt, Artificial Sequence
  Antisense Sequence
ccucauaccucuagucuuuc

SEQ ID NO: 873 - RNA, 20 nt, Artificial Sequence
  Antisense Sequence
cccucauaccucuagucuuu

SEQ ID NO: 874 - RNA, 20 nt, Artificial Sequence
  Antisense Sequence
ucccucauaccucuagucuu

SEQ ID NO: 875 - RNA, 20 nt, Artificial Sequence
  Antisense Sequence
uucccucauaccucuagucu

SEQ ID NO: 876 - RNA, 20 nt, Artificial Sequence
  Antisense Sequence
uuucccucauaccucuaguc

SEQ ID NO: 877 - RNA, 20 nt, Artificial Sequence
  Antisense Sequence
uuuucccucauaccucuagu

SEQ ID NO: 878 - RNA, 20 nt, Artificial Sequence
  Antisense Sequence
auuuucccucauaccucuag

SEQ ID NO: 879 - RNA, 20 nt, Artificial Sequence
  Antisense Sequence
gcaauuuucccucauaccuc

SEQ ID NO: 880 - RNA, 20 nt, Artificial Sequence
  Antisense Sequence
acgccuuaugagccaggugg

SEQ ID NO: 881 - RNA, 20 nt, Artificial Sequence
  Antisense Sequence
aacgccuuaugagccaggug

SEQ ID NO: 882 - RNA, 20 nt, Artificial Sequence
  Antisense Sequence
gaacgccuuaugagccaggu

SEQ ID NO: 883 - RNA, 20 nt, Artificial Sequence
  Antisense Sequence
gggaacgccuuaugagccag

SEQ ID NO: 884 - RNA, 20 nt, Artificial Sequence
  Antisense Sequence
agggaacgccuuaugagcca

SEQ ID NO: 885 - RNA, 20 nt, Artificial Sequence
  Antisense Sequence
gagggaacgccuuaugagcc

SEQ ID NO: 886 - RNA, 20 nt, Artificial Sequence
  Antisense Sequence
ggagggaacgccuuaugagc

SEQ ID NO: 887 - RNA, 20 nt, Artificial Sequence
  Antisense Sequence
gggagggaacgccuuaugag

SEQ ID NO: 888 - RNA, 20 nt, Artificial Sequence
  Antisense Sequence
gaugauuucacaugcucagu

SEQ ID NO: 889 - RNA, 20 nt, Artificial Sequence
  Antisense Sequence
aggaugauuucacaugcuca

SEQ ID NO: 890 - RNA, 20 nt, Artificial Sequence
  Antisense Sequence
gaggaugauuucacaugcuc

SEQ ID NO: 891 - RNA, 20 nt, Artificial Sequence
  Antisense Sequence
agaggaugauuucacaugcu

SEQ ID NO: 892 - RNA, 20 nt, Artificial Sequence
  Antisense Sequence
caugaugcaagaaagaggau

SEQ ID NO: 893 - RNA, 20 nt, Artificial Sequence
  Antisense Sequence
gcaugaugcaagaaagagga

SEQ ID NO: 894 - RNA, 20 nt, Artificial Sequence
  Antisense Sequence
cacgcaugaugcaagaaaga

SEQ ID NO: 895 - RNA, 20 nt, Artificial Sequence
  Antisense Sequence
acacgcaugaugcaagaaag

SEQ ID NO: 896 - RNA, 20 nt, Artificial Sequence
  Antisense Sequence
gacacgcaugaugcaagaaa

SEQ ID NO: 897 - RNA, 20 nt, Artificial Sequence
  Antisense Sequence
ggacacgcaugaugcaagaa

SEQ ID NO: 898 - RNA, 20 nt, Artificial Sequence
  Antisense Sequence
uggacacgcaugaugcaaga

SEQ ID NO: 899 - RNA, 20 nt, Artificial Sequence
  Antisense Sequence
guggacacgcaugaugcaag

SEQ ID NO: 900 - RNA, 20 nt, Artificial Sequence
  Antisense Sequence
uguggacacgcaugaugcaa

SEQ ID NO: 901 - RNA, 20 nt, Artificial Sequence
  Antisense Sequence
auguggacacgcaugaugca

SEQ ID NO: 902 - RNA, 20 nt, Artificial Sequence
  Antisense Sequence
caauguggacacgcaugaug

SEQ ID NO: 903 - RNA, 20 nt, Artificial Sequence
  Antisense Sequence
gcaauguggacacgcaugau

SEQ ID NO: 904 - RNA, 20 nt, Artificial Sequence
  Antisense Sequence
gugcaauguggacacgcaug

SEQ ID NO: 905 - RNA, 20 nt, Artificial Sequence
  Antisense Sequence
ggugcaauguggacacgcau

SEQ ID NO: 906 - RNA, 20 nt, Artificial Sequence
  Antisense Sequence
gggugcaauguggacacgca

SEQ ID NO: 907 - RNA, 20 nt, Artificial Sequence
  Antisense Sequence
ugacugggccugaaguaggg

SEQ ID NO: 908 - RNA, 20 nt, Artificial Sequence
  Antisense Sequence
cauggugacugggccugaag

SEQ ID NO: 909 - RNA, 20 nt, Artificial Sequence
  Antisense Sequence
cucagguuucaccaucuggc

SEQ ID NO: 910 - RNA, 20 nt, Artificial Sequence
  Antisense Sequence
cagcucagguuucaccaucu

SEQ ID NO: 911 - RNA, 20 nt, Artificial Sequence
  Antisense Sequence
ucagcucagguuucaccauc

SEQ ID NO: 912 - RNA, 20 nt, Artificial Sequence
  Antisense Sequence
aucagcucagguuucaccau

SEQ ID NO: 913 - RNA, 20 nt, Artificial Sequence
  Antisense Sequence
caucagcucagguuucacca

SEQ ID NO: 914 - RNA, 20 nt, Artificial Sequence
  Antisense Sequence
ucugagucccaggauuggcc

SEQ ID NO: 915 - RNA, 20 nt, Artificial Sequence
  Antisense Sequence
ccucugagucccaggauugg

SEQ ID NO: 916 - RNA, 20 nt, Artificial Sequence
  Antisense Sequence
cccucugagucccaggauug

SEQ ID NO: 917 - RNA, 20 nt, Artificial Sequence
  Antisense Sequence
acccucugagucccaggauu

SEQ ID NO: 918 - RNA, 20 nt, Artificial Sequence
  Antisense Sequence
uacccucugagucccaggau

SEQ ID NO: 919 - RNA, 20 nt, Artificial Sequence
  Antisense Sequence
cuacccucugagucccagga

SEQ ID NO: 920 - RNA, 20 nt, Artificial Sequence
  Antisense Sequence
agccgaccuacccucugagu

SEQ ID NO: 921 - RNA, 20 nt, Artificial Sequence
  Antisense Sequence
aaccuaguggucagccagcc

SEQ ID NO: 922 - RNA, 20 nt, Artificial Sequence
  Antisense Sequence
aaaccuaguggucagccagc

SEQ ID NO: 923 - RNA, 20 nt, Artificial Sequence
  Antisense Sequence
ccaaaccuaguggucagcca

SEQ ID NO: 924 - RNA, 20 nt, Artificial Sequence
  Antisense Sequence
uccaaaccuaguggucagcc

SEQ ID NO: 925 - RNA, 20 nt, Artificial Sequence
  Antisense Sequence
uuccaaaccuaguggucagc

SEQ ID NO: 926 - RNA, 20 nt, Artificial Sequence
  Antisense Sequence
ucuuccaaaccuagugguca

SEQ ID NO: 927 - RNA, 20 nt, Artificial Sequence
  Antisense Sequence
gucuuccaaaccuagugguc

SEQ ID NO: 928 - RNA, 20 nt, Artificial Sequence
  Antisense Sequence
ggucuuccaaaccuaguggu

SEQ ID NO: 929 - RNA, 20 nt, Artificial Sequence
  Antisense Sequence
gggucuuccaaaccuagugg

SEQ ID NO: 930 - RNA, 20 nt, Artificial Sequence
  Antisense Sequence
ugggucuuccaaaccuagug

SEQ ID NO: 931 - RNA, 20 nt, Artificial Sequence
  Antisense Sequence
cugggucuuccaaaccuagu

SEQ ID NO: 932 - RNA, 20 nt, Artificial Sequence
  Antisense Sequence
ccugggucuuccaaaccuag

SEQ ID NO: 933 - RNA, 20 nt, Artificial Sequence
  Antisense Sequence
gcugccugggucuuccaaac

SEQ ID NO: 934 - RNA, 20 nt, Artificial Sequence
  Antisense Sequence
gggccucuuuagagccagcu

SEQ ID NO: 935 - RNA, 20 nt, Artificial Sequence
  Antisense Sequence
augucuggcuacugaccugg

SEQ ID NO: 936 - RNA, 20 nt, Artificial Sequence
  Antisense Sequence
ucaugucuggcuacugaccu

SEQ ID NO: 937 - RNA, 20 nt, Artificial Sequence
  Antisense Sequence
cucaugucuggcuacugacc

SEQ ID NO: 938 - RNA, 20 nt, Artificial Sequence
  Antisense Sequence
gcucaugucuggcuacugac

SEQ ID NO: 939 - RNA, 20 nt, Artificial Sequence
  Antisense Sequence
agcucaugucuggcuacuga

SEQ ID NO: 940 - RNA, 20 nt, Artificial Sequence
  Antisense Sequence
cagcucaugucuggcuacug

SEQ ID NO: 941 - RNA, 20 nt, Artificial Sequence
  Antisense Sequence
acagcucaugucuggcuacu

SEQ ID NO: 942 - RNA, 20 nt, Artificial Sequence
  Antisense Sequence
ugacccucacagcucauguc

SEQ ID NO: 943 - RNA, 20 nt, Artificial Sequence
  Antisense Sequence
uugacccucacagcucaugu

SEQ ID NO: 944 - RNA, 20 nt, Artificial Sequence
  Antisense Sequence
ugcuugacccucacagcuca

SEQ ID NO: 945 - RNA, 20 nt, Artificial Sequence
  Antisense Sequence
gugcuugacccucacagcuc

SEQ ID NO: 946 - RNA, 20 nt, Artificial Sequence
  Antisense Sequence
uagcugugcuugacccucac

SEQ ID NO: 947 - RNA, 20 nt, Artificial Sequence
  Antisense Sequence
auagcugugcuugacccuca

SEQ ID NO: 948 - RNA, 20 nt, Artificial Sequence
  Antisense Sequence
gauagcugugcuugacccuc

SEQ ID NO: 949 - RNA, 20 nt, Artificial Sequence
  Antisense Sequence
ggauagcugugcuugacccu

SEQ ID NO: 950 - RNA, 20 nt, Artificial Sequence
  Antisense Sequence
uggauagcugugcuugaccc

SEQ ID NO: 951 - RNA, 20 nt, Artificial Sequence
  Antisense Sequence
auggauagcugugcuugacc

SEQ ID NO: 952 - RNA, 20 nt, Artificial Sequence
  Antisense Sequence
gauggauagcugugcuugac

SEQ ID NO: 953 - RNA, 20 nt, Artificial Sequence
  Antisense Sequence
ugauggauagcugugcuuga

SEQ ID NO: 954 - RNA, 20 nt, Artificial Sequence
  Antisense Sequence
aucugauggauagcugugcu

SEQ ID NO: 955 - RNA, 20 nt, Artificial Sequence
  Antisense Sequence
caucugauggauagcugugc

SEQ ID NO: 956 - RNA, 20 nt, Artificial Sequence
  Antisense Sequence
aucaucugauggauagcugu

SEQ ID NO: 957 - RNA, 20 nt, Artificial Sequence
  Antisense Sequence
gaucaucugauggauagcug

SEQ ID NO: 958 - RNA, 20 nt, Artificial Sequence
  Antisense Sequence
agaucaucugauggauagcu

SEQ ID NO: 959 - RNA, 20 nt, Artificial Sequence
  Antisense Sequence
uagaucaucugauggauagc

SEQ ID NO: 960 - RNA, 20 nt, Artificial Sequence
  Antisense Sequence
guagaucaucugauggauag

SEQ ID NO: 961 - RNA, 20 nt, Artificial Sequence
  Antisense Sequence
gaaaguagaucaucugaugg

SEQ ID NO: 962 - RNA, 20 nt, Artificial Sequence
  Antisense Sequence
gcugaaaguagaucaucuga

SEQ ID NO: 963 - RNA, 20 nt, Artificial Sequence
  Antisense Sequence
aggcugaaaguagaucaucu

SEQ ID NO: 964 - RNA, 20 nt, Artificial Sequence
  Antisense Sequence
aaggcugaaaguagaucauc

SEQ ID NO: 965 - RNA, 20 nt, Artificial Sequence
  Antisense Sequence
gaaggcugaaaguagaucau

SEQ ID NO: 966 - RNA, 20 nt, Artificial Sequence
  Antisense Sequence
ggaaggcugaaaguagauca

SEQ ID NO: 967 - RNA, 20 nt, Artificial Sequence
  Antisense Sequence
aggaaggcugaaaguagauc

SEQ ID NO: 968 - RNA, 20 nt, Artificial Sequence
  Antisense Sequence
gucugggacucaggaaggcu

SEQ ID NO: 969 - RNA, 20 nt, Artificial Sequence
  Antisense Sequence
uauugucugggacucaggaa

SEQ ID NO: 970 - RNA, 20 nt, Artificial Sequence
  Antisense Sequence
cuauugucugggacucagga

SEQ ID NO: 971 - RNA, 20 nt, Artificial Sequence
  Antisense Sequence
ucuauugucugggacucagg

SEQ ID NO: 972 - RNA, 20 nt, Artificial Sequence
  Antisense Sequence
cuucuauugucugggacuca

SEQ ID NO: 973 - RNA, 20 nt, Artificial Sequence
  Antisense Sequence
ucuucuauugucugggacuc

SEQ ID NO: 974 - RNA, 20 nt, Artificial Sequence
  Antisense Sequence
caccugucuucuauugucug

SEQ ID NO: 975 - RNA, 20 nt, Artificial Sequence
  Antisense Sequence
ccaccugucuucuauugucu

SEQ ID NO: 976 - RNA, 20 nt, Artificial Sequence
  Antisense Sequence
gccaccugucuucuauuguc

SEQ ID NO: 977 - RNA, 20 nt, Artificial Sequence
  Antisense Sequence
agccaccugucuucuauugu

SEQ ID NO: 978 - RNA, 20 nt, Artificial Sequence
  Antisense Sequence
augagggcacagugacagca

SEQ ID NO: 979 - RNA, 20 nt, Artificial Sequence
  Antisense Sequence
caaugagggcacagugacag

SEQ ID NO: 980 - RNA, 20 nt, Artificial Sequence
  Antisense Sequence
ccaaugagggcacagugaca

SEQ ID NO: 981 - RNA, 20 nt, Artificial Sequence
  Antisense Sequence
cgucuguugagucugauugc

SEQ ID NO: 982 - RNA, 20 nt, Artificial Sequence
  Antisense Sequence
ccgucuguugagucugauug

SEQ ID NO: 983 - RNA, 20 nt, Artificial Sequence
  Antisense Sequence
uccgucuguugagucugauu

SEQ ID NO: 984 - RNA, 20 nt, Artificial Sequence
  Antisense Sequence
cuccgucuguugagucugau

SEQ ID NO: 985 - RNA, 20 nt, Artificial Sequence
  Antisense Sequence
gcuccgucuguugagucuga

SEQ ID NO: 986 - RNA, 20 nt, Artificial Sequence
  Antisense Sequence
ugcuccgucuguugagucug

SEQ ID NO: 987 - RNA, 20 nt, Artificial Sequence
  Antisense Sequence
uugcuccgucuguugagucu

SEQ ID NO: 988 - RNA, 20 nt, Artificial Sequence
  Antisense Sequence
aguugcuccgucuguugagu

SEQ ID NO: 989 - RNA, 20 nt, Artificial Sequence
  Antisense Sequence
gcaguugcuccgucuguuga

SEQ ID NO: 990 - RNA, 20 nt, Artificial Sequence
  Antisense Sequence
ggcaguugcuccgucuguug

SEQ ID NO: 991 - RNA, 20 nt, Artificial Sequence
  Antisense Sequence
gauggcaguugcuccgucug

SEQ ID NO: 992 - RNA, 20 nt, Artificial Sequence
  Antisense Sequence
ggauggcaguugcuccgucu

SEQ ID NO: 993 - RNA, 20 nt, Artificial Sequence
  Antisense Sequence
agccucggauggcaguugcu

SEQ ID NO: 994 - RNA, 20 nt, Artificial Sequence
  Antisense Sequence
aggagccucggauggcaguu

SEQ ID NO: 995 - RNA, 20 nt, Artificial Sequence
  Antisense Sequence
uucaggagccucggauggca

SEQ ID NO: 996 - RNA, 20 nt, Artificial Sequence
  Antisense Sequence
ugguucaggagccucggaug

SEQ ID NO: 997 - RNA, 20 nt, Artificial Sequence
  Antisense Sequence
cugguucaggagccucggau

SEQ ID NO: 998 - RNA, 20 nt, Artificial Sequence
  Antisense Sequence
cuggugaauggcccugguuc

SEQ ID NO: 999 - RNA, 20 nt, Artificial Sequence
  Antisense Sequence
ccuggugaauggcccugguu

SEQ ID NO: 1000 - RNA, 20 nt, Artificial Sequence
  Antisense Sequence
uccuggugaauggcccuggu

SEQ ID NO: 1001 - RNA, 20 nt, Artificial Sequence
  Antisense Sequence
uggacaucagggagccgcau

SEQ ID NO: 1002 - RNA, 20 nt, Artificial Sequence
  Antisense Sequence
aggauuugcugcuuggcuag

SEQ ID NO: 1003 - RNA, 20 nt, Artificial Sequence
  Antisense Sequence
caggauuugcugcuuggcua

SEQ ID NO: 1004 - RNA, 20 nt, Artificial Sequence
  Antisense Sequence
uccaggauuugcugcuuggc

SEQ ID NO: 1005 - RNA, 20 nt, Artificial Sequence
  Antisense Sequence
acccauccaggauuugcugc

SEQ ID NO: 1006 - RNA, 20 nt, Artificial Sequence
  Antisense Sequence
aacccauccaggauuugcug

SEQ ID NO: 1007 - RNA, 20 nt, Artificial Sequence
  Antisense Sequence
caacccauccaggauuugcu

SEQ ID NO: 1008 - RNA, 20 nt, Artificial Sequence
  Antisense Sequence
ugcaacccauccaggauuug

SEQ ID NO: 1009 - RNA, 20 nt, Artificial Sequence
  Antisense Sequence
gugcaacccauccaggauuu

SEQ ID NO: 1010 - RNA, 20 nt, Artificial Sequence
  Antisense Sequence
ggugcaacccauccaggauu

SEQ ID NO: 1011 - RNA, 20 nt, Artificial Sequence
  Antisense Sequence
aggugcaacccauccaggau

SEQ ID NO: 1012 - RNA, 20 nt, Artificial Sequence
  Antisense Sequence
caggugcaacccauccagga

SEQ ID NO: 1013 - RNA, 20 nt, Artificial Sequence
  Antisense Sequence
ucaggugcaacccauccagg

SEQ ID NO: 1014 - RNA, 20 nt, Artificial Sequence
  Antisense Sequence
gucaggugcaacccauccag

SEQ ID NO: 1015 - RNA, 20 nt, Artificial Sequence
  Antisense Sequence
ggucaggugcaacccaucca

SEQ ID NO: 1016 - RNA, 20 nt, Artificial Sequence
  Antisense Sequence
uggucaggugcaacccaucc

SEQ ID NO: 1017 - RNA, 20 nt, Artificial Sequence
  Antisense Sequence
cuggucaggugcaacccauc

SEQ ID NO: 1018 - RNA, 20 nt, Artificial Sequence
  Antisense Sequence
acuggucaggugcaacccau

SEQ ID NO: 1019 - RNA, 20 nt, Artificial Sequence
  Antisense Sequence
gacuggucaggugcaaccca

SEQ ID NO: 1020 - RNA, 20 nt, Artificial Sequence
  Antisense Sequence
acgacuggucaggugcaacc

SEQ ID NO: 1021 - RNA, 20 nt, Artificial Sequence
  Antisense Sequence
gacgacuggucaggugcaac

SEQ ID NO: 1022 - RNA, 20 nt, Artificial Sequence
  Antisense Sequence
ggacgacuggucaggugcaa

SEQ ID NO: 1023 - RNA, 20 nt, Artificial Sequence
  Antisense Sequence
ucugggacgacuggucaggu

SEQ ID NO: 1024 - RNA, 20 nt, Artificial Sequence
  Antisense Sequence
uucugggacgacuggucagg

SEQ ID NO: 1025 - RNA, 20 nt, Artificial Sequence
  Antisense Sequence
auucugggacgacuggucag

SEQ ID NO: 1026 - RNA, 20 nt, Artificial Sequence
  Antisense Sequence
uauucugggacgacugguca

SEQ ID NO: 1027 - RNA, 20 nt, Artificial Sequence
  Antisense Sequence
uuauucugggacgacugguc

SEQ ID NO: 1028 - RNA, 20 nt, Artificial Sequence
  Antisense Sequence
guuauucugggacgacuggu

SEQ ID NO: 1029 - RNA, 20 nt, Artificial Sequence
  Antisense Sequence
aguuauucugggacgacugg

SEQ ID NO: 1030 - RNA, 20 nt, Artificial Sequence
  Antisense Sequence
gaguuauucugggacgacug

SEQ ID NO: 1031 - RNA, 20 nt, Artificial Sequence
  Antisense Sequence
ugaguuauucugggacgacu

SEQ ID NO: 1032 - RNA, 20 nt, Artificial Sequence
  Antisense Sequence
augaguuauucugggacgac

SEQ ID NO: 1033 - RNA, 20 nt, Artificial Sequence
  Antisense Sequence
gaugaguuauucugggacga

SEQ ID NO: 1034 - RNA, 20 nt, Artificial Sequence
  Antisense Sequence
ggaugaguuauucugggacg

SEQ ID NO: 1035 - RNA, 20 nt, Artificial Sequence
  Antisense Sequence
uggaggaugaguuauucugg

SEQ ID NO: 1036 - RNA, 20 nt, Artificial Sequence
  Antisense Sequence
guggaggaugaguuauucug

SEQ ID NO: 1037 - RNA, 20 nt, Artificial Sequence
  Antisense Sequence
gguggaggaugaguuauucu

SEQ ID NO: 1038 - RNA, 20 nt, Artificial Sequence
  Antisense Sequence
ggguggaggaugaguuauuc

SEQ ID NO: 1039 - RNA, 20 nt, Artificial Sequence
  Antisense Sequence
aaagcugaugaccuccuccc

SEQ ID NO: 1040 - RNA, 20 nt, Artificial Sequence
  Antisense Sequence
caaagcugaugaccuccucc

SEQ ID NO: 1041 - RNA, 20 nt, Artificial Sequence
  Antisense Sequence
agcaaagcugaugaccuccu

SEQ ID NO: 1042 - RNA, 20 nt, Artificial Sequence
  Antisense Sequence
uagcaaagcugaugaccucc

SEQ ID NO: 1043 - RNA, 20 nt, Artificial Sequence
  Antisense Sequence
guagcaaagcugaugaccuc

SEQ ID NO: 1044 - RNA, 20 nt, Artificial Sequence
  Antisense Sequence
aguagcaaagcugaugaccu

SEQ ID NO: 1045 - RNA, 20 nt, Artificial Sequence
  Antisense Sequence
acaguagcaaagcugaugac

SEQ ID NO: 1046 - RNA, 20 nt, Artificial Sequence
  Antisense Sequence
ugacaguagcaaagcugaug

SEQ ID NO: 1047 - RNA, 20 nt, Artificial Sequence
  Antisense Sequence
gugacaguagcaaagcugau

SEQ ID NO: 1048 - RNA, 20 nt, Artificial Sequence
  Antisense Sequence
accugugacaguagcaaagc

SEQ ID NO: 1049 - RNA, 20 nt, Artificial Sequence
  Antisense Sequence
caccugugacaguagcaaag

SEQ ID NO: 1050 - RNA, 20 nt, Artificial Sequence
  Antisense Sequence
ccaccugugacaguagcaaa

SEQ ID NO: 1051 - RNA, 20 nt, Artificial Sequence
  Antisense Sequence
cccaccugugacaguagcaa

SEQ ID NO: 1052 - RNA, 20 nt, Artificial Sequence
  Antisense Sequence
acccaccugugacaguagca

SEQ ID NO: 1053 - RNA, 20 nt, Artificial Sequence
  Antisense Sequence
cacccaccugugacaguagc

SEQ ID NO: 1054 - RNA, 20 nt, Artificial Sequence
  Antisense Sequence
guugcucucucccucaccca

SEQ ID NO: 1055 - RNA, 20 nt, Artificial Sequence
  Antisense Sequence
ccuguugcucucucccucac

SEQ ID NO: 1056 - RNA, 20 nt, Artificial Sequence
  Antisense Sequence
gccuguugcucucucccuca

SEQ ID NO: 1057 - RNA, 20 nt, Artificial Sequence
  Antisense Sequence
ugccuguugcucucucccuc

SEQ ID NO: 1058 - RNA, 20 nt, Artificial Sequence
  Antisense Sequence
cccugucugcucuuugccug

SEQ ID NO: 1059 - RNA, 20 nt, Artificial Sequence
  Antisense Sequence
uuucccugucugcucuuugc

SEQ ID NO: 1060 - RNA, 20 nt, Artificial Sequence
  Antisense Sequence
uccucugcaaccagucccug

SEQ ID NO: 1061 - RNA, 20 nt, Artificial Sequence
  Antisense Sequence
guccucugcaaccagucccu

SEQ ID NO: 1062 - RNA, 20 nt, Artificial Sequence
  Antisense Sequence
guguccucugcaaccagucc

SEQ ID NO: 1063 - RNA, 20 nt, Artificial Sequence
  Antisense Sequence
uguguccucugcaaccaguc

SEQ ID NO: 1064 - RNA, 20 nt, Artificial Sequence
  Antisense Sequence
uuguguccucugcaaccagu

SEQ ID NO: 1065 - RNA, 20 nt, Artificial Sequence
  Antisense Sequence
acugcuuuguguccucugca

SEQ ID NO: 1066 - RNA, 20 nt, Artificial Sequence
  Antisense Sequence
gacugcuuuguguccucugc

SEQ ID NO: 1067 - RNA, 20 nt, Artificial Sequence
  Antisense Sequence
gagacugcuuuguguccucu

SEQ ID NO: 1068 - RNA, 20 nt, Artificial Sequence
  Antisense Sequence
agagacugcuuuguguccuc

SEQ ID NO: 1069 - RNA, 20 nt, Artificial Sequence
  Antisense Sequence
uagagacugcuuuguguccu

SEQ ID NO: 1070 - RNA, 20 nt, Artificial Sequence
  Antisense Sequence
ucccucgaaccuaccucuag

SEQ ID NO: 1071 - RNA, 20 nt, Artificial Sequence
  Antisense Sequence
cucccucgaaccuaccucua

SEQ ID NO: 1072 - RNA, 20 nt, Artificial Sequence
  Antisense Sequence
ucucccucgaaccuaccucu

SEQ ID NO: 1073 - RNA, 20 nt, Artificial Sequence
  Antisense Sequence
cucucccucgaaccuaccuc

SEQ ID NO: 1074 - RNA, 20 nt, Artificial Sequence
  Antisense Sequence
acugcucucccucgaaccua

SEQ ID NO: 1075 - RNA, 20 nt, Artificial Sequence
  Antisense Sequence
agaugaagcucuccucugag

SEQ ID NO: 1076 - RNA, 20 nt, Artificial Sequence
  Antisense Sequence
augugaguagagaugaagcu

SEQ ID NO: 1077 - RNA, 20 nt, Artificial Sequence
  Antisense Sequence
ugcccgaaagacagaaaagg

SEQ ID NO: 1078 - RNA, 20 nt, Artificial Sequence
  Antisense Sequence
cugcccgaaagacagaaaag

SEQ ID NO: 1079 - RNA, 20 nt, Artificial Sequence
  Antisense Sequence
aguggagucugcccgaaaga

SEQ ID NO: 1080 - RNA, 20 nt, Artificial Sequence
  Antisense Sequence
aaguggagucugcccgaaag

SEQ ID NO: 1081 - RNA, 20 nt, Artificial Sequence
  Antisense Sequence
gaaguggagucugcccgaaa

SEQ ID NO: 1082 - RNA, 20 nt, Artificial Sequence
  Antisense Sequence
aggcugaaguggagucugcc

SEQ ID NO: 1083 - RNA, 20 nt, Artificial Sequence
  Antisense Sequence
uaggcugaaguggagucugc

SEQ ID NO: 1084 - RNA, 20 nt, Artificial Sequence
  Antisense Sequence
guaggcugaaguggagucug

SEQ ID NO: 1085 - RNA, 20 nt, Artificial Sequence
  Antisense Sequence
gcuguaggcugaaguggagu

SEQ ID NO: 1086 - RNA, 20 nt, Artificial Sequence
  Antisense Sequence
agcuguaggcugaaguggag

SEQ ID NO: 1087 - RNA, 20 nt, Artificial Sequence
  Antisense Sequence
gagcuguaggcugaagugga

SEQ ID NO: 1088 - RNA, 20 nt, Artificial Sequence
  Antisense Sequence
gggagcuguaggcugaagug

SEQ ID NO: 1089 - RNA, 20 nt, Artificial Sequence
  Antisense Sequence
agggagcuguaggcugaagu

SEQ ID NO: 1090 - RNA, 20 nt, Artificial Sequence
  Antisense Sequence
aagugagcagggagcuguag

SEQ ID NO: 1091 - RNA, 20 nt, Artificial Sequence
  Antisense Sequence
uggacaggugaaaagugagc

SEQ ID NO: 1092 - RNA, 20 nt, Artificial Sequence
  Antisense Sequence
guggacaggugaaaagugag

SEQ ID NO: 1093 - RNA, 20 nt, Artificial Sequence
  Antisense Sequence
aguggacaggugaaaaguga

SEQ ID NO: 1094 - RNA, 20 nt, Artificial Sequence
  Antisense Sequence
gaguggacaggugaaaagug

SEQ ID NO: 1095 - RNA, 20 nt, Artificial Sequence
  Antisense Sequence
ggaguggacaggugaaaagu

SEQ ID NO: 1096 - RNA, 20 nt, Artificial Sequence
  Antisense Sequence
aggaguggacaggugaaaag

SEQ ID NO: 1097 - RNA, 20 nt, Artificial Sequence
  Antisense Sequence
gaggaguggacaggugaaaa

SEQ ID NO: 1098 - RNA, 20 nt, Artificial Sequence
  Antisense Sequence
cgaggaguggacaggugaaa

SEQ ID NO: 1099 - RNA, 20 nt, Artificial Sequence
  Antisense Sequence
ccgaggaguggacaggugaa

SEQ ID NO: 1100 - RNA, 20 nt, Artificial Sequence
  Antisense Sequence
accgaggaguggacagguga

SEQ ID NO: 1101 - RNA, 20 nt, Artificial Sequence
  Antisense Sequence
caugguacagguggugggac

SEQ ID NO: 1102 - RNA, 20 nt, Artificial Sequence
  Antisense Sequence
gcaugguacaggugguggga

SEQ ID NO: 1103 - RNA, 20 nt, Artificial Sequence
  Antisense Sequence
caaagagugccaggaagggu

SEQ ID NO: 1104 - RNA, 20 nt, Artificial Sequence
  Antisense Sequence
gcaaagagugccaggaaggg

SEQ ID NO: 1105 - RNA, 20 nt, Artificial Sequence
  Antisense Sequence
aagcaaagagugccaggaag

SEQ ID NO: 1106 - RNA, 20 nt, Artificial Sequence
  Antisense Sequence
ucaagcaaagagugccagga

SEQ ID NO: 1107 - RNA, 20 nt, Artificial Sequence
  Antisense Sequence
cucaagcaaagagugccagg

SEQ ID NO: 1108 - RNA, 20 nt, Artificial Sequence
  Antisense Sequence
ccucaagcaaagagugccag

SEQ ID NO: 1109 - RNA, 20 nt, Artificial Sequence
  Antisense Sequence
auccucaagcaaagagugcc

SEQ ID NO: 1110 - RNA, 20 nt, Artificial Sequence
  Antisense Sequence
gauccucaagcaaagagugc

SEQ ID NO: 1111 - RNA, 20 nt, Artificial Sequence
  Antisense Sequence
gaagauccucaagcaaagag

SEQ ID NO: 1112 - RNA, 20 nt, Artificial Sequence
  Antisense Sequence
ggaagauccucaagcaaaga

SEQ ID NO: 1113 - RNA, 20 nt, Artificial Sequence
  Antisense Sequence
cggaagauccucaagcaaag

SEQ ID NO: 1114 - RNA, 20 nt, Artificial Sequence
  Antisense Sequence
aucggaagauccucaagcaa

SEQ ID NO: 1115 - RNA, 20 nt, Artificial Sequence
  Antisense Sequence
caucggaagauccucaagca

SEQ ID NO: 1116 - RNA, 20 nt, Artificial Sequence
  Antisense Sequence
ccaucggaagauccucaagc

SEQ ID NO: 1117 - RNA, 20 nt, Artificial Sequence
  Antisense Sequence
cccaucggaagauccucaag

SEQ ID NO: 1118 - RNA, 20 nt, Artificial Sequence
  Antisense Sequence
auguggugcucagccaggag

SEQ ID NO: 1119 - RNA, 20 nt, Artificial Sequence
  Antisense Sequence
uuggugauguggugcucagc

SEQ ID NO: 1120 - RNA, 20 nt, Artificial Sequence
  Antisense Sequence
gguuggugauguggugcuca

SEQ ID NO: 1121 - RNA, 20 nt, Artificial Sequence
  Antisense Sequence
agguuggugauguggugcuc

SEQ ID NO: 1122 - RNA, 20 nt, Artificial Sequence
  Antisense Sequence
cagguuggugauguggugcu

SEQ ID NO: 1123 - RNA, 20 nt, Artificial Sequence
  Antisense Sequence
agcccagguuggugaugugg

SEQ ID NO: 1124 - RNA, 20 nt, Artificial Sequence
  Antisense Sequence
cagcccagguuggugaugug

SEQ ID NO: 1125 - RNA, 20 nt, Artificial Sequence
  Antisense Sequence
ugccagcccagguuggugau

SEQ ID NO: 1126 - RNA, 20 nt, Artificial Sequence
  Antisense Sequence
augccagcccagguugguga

SEQ ID NO: 1127 - RNA, 20 nt, Artificial Sequence
  Antisense Sequence
guaugccagcccagguuggu

SEQ ID NO: 1128 - RNA, 20 nt, Artificial Sequence
  Antisense Sequence
agguaugccagcccagguug

SEQ ID NO: 1129 - RNA, 20 nt, Artificial Sequence
  Antisense Sequence
aagguaugccagcccagguu

SEQ ID NO: 1130 - RNA, 20 nt, Artificial Sequence
  Antisense Sequence
uaagguaugccagcccaggu

SEQ ID NO: 1131 - RNA, 20 nt, Artificial Sequence
  Antisense Sequence
uuaagguaugccagcccagg

SEQ ID NO: 1132 - RNA, 20 nt, Artificial Sequence
  Antisense Sequence
guuaagguaugccagcccag

SEQ ID NO: 1133 - RNA, 20 nt, Artificial Sequence
  Antisense Sequence
aguuaagguaugccagccca

SEQ ID NO: 1134 - RNA, 20 nt, Artificial Sequence
  Antisense Sequence
gaguuaagguaugccagccc

SEQ ID NO: 1135 - RNA, 20 nt, Artificial Sequence
  Antisense Sequence
agaguuaagguaugccagcc

SEQ ID NO: 1136 - RNA, 20 nt, Artificial Sequence
  Antisense Sequence
cagaguuaagguaugccagc

SEQ ID NO: 1137 - RNA, 20 nt, Artificial Sequence
  Antisense Sequence
gcagaguuaagguaugccag

SEQ ID NO: 1138 - RNA, 20 nt, Artificial Sequence
  Antisense Sequence
agggcagaguuaagguaugc

SEQ ID NO: 1139 - RNA, 20 nt, Artificial Sequence
  Antisense Sequence
agagggcagaguuaagguau

SEQ ID NO: 1140 - RNA, 20 nt, Artificial Sequence
  Antisense Sequence
uagagggcagaguuaaggua

SEQ ID NO: 1141 - RNA, 20 nt, Artificial Sequence
  Antisense Sequence
cuagagggcagaguuaaggu

SEQ ID NO: 1142 - RNA, 20 nt, Artificial Sequence
  Antisense Sequence
cacuagagggcagaguuaag

SEQ ID NO: 1143 - RNA, 20 nt, Artificial Sequence
  Antisense Sequence
gccacuagagggcagaguua

SEQ ID NO: 1144 - RNA, 20 nt, Artificial Sequence
  Antisense Sequence
ggacaccagacuucucaccc

SEQ ID NO: 1145 - RNA, 20 nt, Artificial Sequence
  Antisense Sequence
aggacaccagacuucucacc

SEQ ID NO: 1146 - RNA, 20 nt, Artificial Sequence
  Antisense Sequence
caggacaccagacuucucac

SEQ ID NO: 1147 - RNA, 20 nt, Artificial Sequence
  Antisense Sequence
uuucaggacaccagacuucu

SEQ ID NO: 1148 - RNA, 20 nt, Artificial Sequence
  Antisense Sequence
guuucaggacaccagacuuc

SEQ ID NO: 1149 - RNA, 20 nt, Artificial Sequence
  Antisense Sequence
uaguugcaguuucaggacac

SEQ ID NO: 1150 - RNA, 20 nt, Artificial Sequence
  Antisense Sequence
cuaguugcaguuucaggaca

SEQ ID NO: 1151 - RNA, 20 nt, Artificial Sequence
  Antisense Sequence
ucuaguugcaguuucaggac

SEQ ID NO: 1152 - RNA, 20 nt, Artificial Sequence
  Antisense Sequence
gucuaguugcaguuucagga

SEQ ID NO: 1153 - RNA, 20 nt, Artificial Sequence
  Antisense Sequence
agucuaguugcaguuucagg

SEQ ID NO: 1154 - RNA, 20 nt, Artificial Sequence
  Antisense Sequence
cagucuaguugcaguuucag

SEQ ID NO: 1155 - RNA, 20 nt, Artificial Sequence
  Antisense Sequence
aacugugcuguugccuucua

SEQ ID NO: 1156 - RNA, 20 nt, Artificial Sequence
  Antisense Sequence
uaacugugcuguugccuucu

SEQ ID NO: 1157 - RNA, 20 nt, Artificial Sequence
  Antisense Sequence
guaacugugcuguugccuuc

SEQ ID NO: 1158 - RNA, 20 nt, Artificial Sequence
  Antisense Sequence
ccaguaacugugcuguugcc

SEQ ID NO: 1159 - RNA, 20 nt, Artificial Sequence
  Antisense Sequence
guccaguaacugugcuguug

SEQ ID NO: 1160 - RNA, 20 nt, Artificial Sequence
  Antisense Sequence
uguccaguaacugugcuguu

SEQ ID NO: 1161 - RNA, 20 nt, Artificial Sequence
  Antisense Sequence
uuguccaguaacugugcugu

SEQ ID NO: 1162 - RNA, 20 nt, Artificial Sequence
  Antisense Sequence
gguuguccaguaacugugcu

SEQ ID NO: 1163 - RNA, 20 nt, Artificial Sequence
  Antisense Sequence
cgguuguccaguaacugugc

SEQ ID NO: 1164 - RNA, 20 nt, Artificial Sequence
  Antisense Sequence
ucgguuguccaguaacugug

SEQ ID NO: 1165 - RNA, 20 nt, Artificial Sequence
  Antisense Sequence
cucgguuguccaguaacugu

SEQ ID NO: 1166 - RNA, 20 nt, Artificial Sequence
  Antisense Sequence
ccucgguuguccaguaacug

SEQ ID NO: 1167 - RNA, 20 nt, Artificial Sequence
  Antisense Sequence
gccucgguuguccaguaacu

SEQ ID NO: 1168 - RNA, 20 nt, Artificial Sequence
  Antisense Sequence
cgccucgguuguccaguaac

SEQ ID NO: 1169 - RNA, 20 nt, Artificial Sequence
  Antisense Sequence
ccgccucgguuguccaguaa

SEQ ID NO: 1170 - RNA, 20 nt, Artificial Sequence
  Antisense Sequence
ugcugguguccugcuguguc

SEQ ID NO: 1171 - RNA, 20 nt, Artificial Sequence
  Antisense Sequence
cugcugguguccugcugugu

SEQ ID NO: 1172 - RNA, 20 nt, Artificial Sequence
  Antisense Sequence
ucuaggaagggcugcuggug

SEQ ID NO: 1173 - RNA, 20 nt, Artificial Sequence
  Antisense Sequence
uuaagcucuaggaagggcug

SEQ ID NO: 1174 - RNA, 20 nt, Artificial Sequence
  Antisense Sequence
cucauuggcucggaucuuaa

SEQ ID NO: 1175 - RNA, 20 nt, Artificial Sequence
  Antisense Sequence
gcucauuggcucggaucuua

SEQ ID NO: 1176 - RNA, 20 nt, Artificial Sequence
  Antisense Sequence
ggcucauuggcucggaucuu

SEQ ID NO: 1177 - RNA, 20 nt, Artificial Sequence
  Antisense Sequence
aggcucauuggcucggaucu

SEQ ID NO: 1178 - RNA, 20 nt, Artificial Sequence
  Antisense Sequence
caggcucauuggcucggauc

SEQ ID NO: 1179 - RNA, 20 nt, Artificial Sequence
  Antisense Sequence
uccaggcucauuggcucgga

SEQ ID NO: 1180 - RNA, 20 nt, Artificial Sequence
  Antisense Sequence
ucucgccugcaacauaaggg

SEQ ID NO: 1181 - RNA, 20 nt, Artificial Sequence
  Antisense Sequence
cagaauggaaagaggcagca

SEQ ID NO: 1182 - RNA, 20 nt, Artificial Sequence
  Antisense Sequence
gcagaauggaaagaggcagc

SEQ ID NO: 1183 - RNA, 20 nt, Artificial Sequence
  Antisense Sequence
aagacggcagaauggaaaga

SEQ ID NO: 1184 - RNA, 20 nt, Artificial Sequence
  Antisense Sequence
gaagacggcagaauggaaag

SEQ ID NO: 1185 - RNA, 20 nt, Artificial Sequence
  Antisense Sequence
ugaagacggcagaauggaaa

SEQ ID NO: 1186 - RNA, 20 nt, Artificial Sequence
  Antisense Sequence
cugaagacggcagaauggaa

SEQ ID NO: 1187 - RNA, 20 nt, Artificial Sequence
  Antisense Sequence
gcugaagacggcagaaugga

SEQ ID NO: 1188 - RNA, 20 nt, Artificial Sequence
  Antisense Sequence
ggcugaagacggcagaaugg

SEQ ID NO: 1189 - RNA, 20 nt, Artificial Sequence
  Antisense Sequence
aggcugaagacggcagaaug

SEQ ID NO: 1190 - RNA, 20 nt, Artificial Sequence
  Antisense Sequence
ggaggcugaagacggcagaa

SEQ ID NO: 1191 - RNA, 20 nt, Artificial Sequence
  Antisense Sequence
aggaggcugaagacggcaga

SEQ ID NO: 1192 - RNA, 20 nt, Artificial Sequence
  Antisense Sequence
uguuggcuuugaggaggcug

SEQ ID NO: 1193 - RNA, 20 nt, Artificial Sequence
  Antisense Sequence
caaggauuguuggcuuugag

SEQ ID NO: 1194 - RNA, 20 nt, Artificial Sequence
  Antisense Sequence
uggcaggccaaggauuguug

SEQ ID NO: 1195 - RNA, 20 nt, Artificial Sequence
  Antisense Sequence
cuggcaggccaaggauuguu

SEQ ID NO: 1196 - RNA, 20 nt, Artificial Sequence
  Antisense Sequence
acuggcaggccaaggauugu

SEQ ID NO: 1197 - RNA, 20 nt, Artificial Sequence
  Antisense Sequence
aggagguacuggcaggccaa

SEQ ID NO: 1198 - RNA, 20 nt, Artificial Sequence
  Antisense Sequence
aacaggagguacuggcaggc

SEQ ID NO: 1199 - RNA, 20 nt, Artificial Sequence
  Antisense Sequence
caacaggagguacuggcagg

SEQ ID NO: 1200 - RNA, 20 nt, Artificial Sequence
  Antisense Sequence
acacaacaggagguacuggc

SEQ ID NO: 1201 - RNA, 20 nt, Artificial Sequence
  Antisense Sequence
agggacacaacaggagguac

SEQ ID NO: 1202 - RNA, 20 nt, Artificial Sequence
  Antisense Sequence
ucgggcaguagggacacaac

SEQ ID NO: 1203 - RNA, 20 nt, Artificial Sequence
  Antisense Sequence
uucgggcaguagggacacaa

SEQ ID NO: 1204 - RNA, 20 nt, Artificial Sequence
  Antisense Sequence
cuucgggcaguagggacaca

SEQ ID NO: 1205 - RNA, 20 nt, Artificial Sequence
  Antisense Sequence
augauccagguagaggagag

SEQ ID NO: 1206 - RNA, 20 nt, Artificial Sequence
  Antisense Sequence
uaugauccagguagaggaga

SEQ ID NO: 1207 - RNA, 20 nt, Artificial Sequence
  Antisense Sequence
uuaugauccagguagaggag

SEQ ID NO: 1208 - RNA, 20 nt, Artificial Sequence
  Antisense Sequence
auuaugauccagguagagga

SEQ ID NO: 1209 - RNA, 20 nt, Artificial Sequence
  Antisense Sequence
cauuaugauccagguagagg

SEQ ID NO: 1210 - RNA, 20 nt, Artificial Sequence
  Antisense Sequence
ccauuaugauccagguagag

SEQ ID NO: 1211 - RNA, 20 nt, Artificial Sequence
  Antisense Sequence
ugccauuaugauccagguag

SEQ ID NO: 1212 - RNA, 20 nt, Artificial Sequence
  Antisense Sequence
uugccauuaugauccaggua

SEQ ID NO: 1213 - RNA, 20 nt, Artificial Sequence
  Antisense Sequence
auugccauuaugauccaggu

SEQ ID NO: 1214 - RNA, 20 nt, Artificial Sequence
  Antisense Sequence
cauugccauuaugauccagg

SEQ ID NO: 1215 - RNA, 20 nt, Artificial Sequence
  Antisense Sequence
acauugccauuaugauccag

SEQ ID NO: 1216 - RNA, 20 nt, Artificial Sequence
  Antisense Sequence
ccacauugccauuaugaucc

SEQ ID NO: 1217 - RNA, 20 nt, Artificial Sequence
  Antisense Sequence
gaccacauugccauuaugau

SEQ ID NO: 1218 - RNA, 20 nt, Artificial Sequence
  Antisense Sequence
ugaccacauugccauuauga

SEQ ID NO: 1219 - RNA, 20 nt, Artificial Sequence
  Antisense Sequence
uugaccacauugccauuaug

SEQ ID NO: 1220 - RNA, 20 nt, Artificial Sequence
  Antisense Sequence
ucuugaccacauugccauua

SEQ ID NO: 1221 - RNA, 20 nt, Artificial Sequence
  Antisense Sequence
gucuugaccacauugccauu

SEQ ID NO: 1222 - RNA, 20 nt, Artificial Sequence
  Antisense Sequence
cgucuugaccacauugccau

SEQ ID NO: 1223 - RNA, 20 nt, Artificial Sequence
  Antisense Sequence
ccgucuugaccacauugcca

SEQ ID NO: 1224 - RNA, 20 nt, Artificial Sequence
  Antisense Sequence
uccgucuugaccacauugcc

SEQ ID NO: 1225 - RNA, 20 nt, Artificial Sequence
  Antisense Sequence
auccgucuugaccacauugc

SEQ ID NO: 1226 - RNA, 20 nt, Artificial Sequence
  Antisense Sequence
cauccgucuugaccacauug

SEQ ID NO: 1227 - RNA, 20 nt, Artificial Sequence
  Antisense Sequence
acauccgucuugaccacauu

SEQ ID NO: 1228 - RNA, 20 nt, Artificial Sequence
  Antisense Sequence
cacauccgucuugaccacau

SEQ ID NO: 1229 - RNA, 20 nt, Artificial Sequence
  Antisense Sequence
gcacauccgucuugaccaca

SEQ ID NO: 1230 - RNA, 20 nt, Artificial Sequence
  Antisense Sequence
ggcacauccgucuugaccac

SEQ ID NO: 1231 - RNA, 20 nt, Artificial Sequence
  Antisense Sequence
uggcacauccgucuugacca

SEQ ID NO: 1232 - RNA, 20 nt, Artificial Sequence
  Antisense Sequence
cuggcacauccgucuugacc

SEQ ID NO: 1233 - RNA, 20 nt, Artificial Sequence
  Antisense Sequence
ucuggcacauccgucuugac

SEQ ID NO: 1234 - RNA, 20 nt, Artificial Sequence
  Antisense Sequence
aucuggcacauccgucuuga

SEQ ID NO: 1235 - RNA, 20 nt, Artificial Sequence
  Antisense Sequence
uaucuggcacauccgucuug

SEQ ID NO: 1236 - RNA, 20 nt, Artificial Sequence
  Antisense Sequence
auaucuggcacauccgucuu

SEQ ID NO: 1237 - RNA, 20 nt, Artificial Sequence
  Antisense Sequence
cauaucuggcacauccgucu

SEQ ID NO: 1238 - RNA, 20 nt, Artificial Sequence
  Antisense Sequence
ccauaucuggcacauccguc

SEQ ID NO: 1239 - RNA, 20 nt, Artificial Sequence
  Antisense Sequence
caccauaucuggcacauccg

SEQ ID NO: 1240 - RNA, 20 nt, Artificial Sequence
  Antisense Sequence
cuccaccaccauaucuggca

SEQ ID NO: 1241 - RNA, 20 nt, Artificial Sequence
  Antisense Sequence
uggucucuucacuccaaagc

SEQ ID NO: 1242 - RNA, 20 nt, Artificial Sequence
  Antisense Sequence
cuucaucuuggucucuucac

SEQ ID NO: 1243 - RNA, 20 nt, Artificial Sequence
  Antisense Sequence
acuucaucuuggucucuuca

SEQ ID NO: 1244 - RNA, 20 nt, Artificial Sequence
  Antisense Sequence
aacuucaucuuggucucuuc

SEQ ID NO: 1245 - RNA, 20 nt, Artificial Sequence
  Antisense Sequence
ggaaacuucaucuuggucuc

SEQ ID NO: 1246 - RNA, 20 nt, Artificial Sequence
  Antisense Sequence
ccuccagucacagaugcccu

SEQ ID NO: 1247 - RNA, 20 nt, Artificial Sequence
  Antisense Sequence
gaugccuccagucacagaug

SEQ ID NO: 1248 - RNA, 20 nt, Artificial Sequence
  Antisense Sequence
ugaugccuccagucacagau

SEQ ID NO: 1249 - RNA, 20 nt, Artificial Sequence
  Antisense Sequence
caggugguuguuggguuggg

SEQ ID NO: 1250 - RNA, 20 nt, Artificial Sequence
  Antisense Sequence
ccaggugguuguuggguugg

SEQ ID NO: 1251 - RNA, 20 nt, Artificial Sequence
  Antisense Sequence
gccaggugguuguuggguug

SEQ ID NO: 1252 - RNA, 20 nt, Artificial Sequence
  Antisense Sequence
ugccaggugguuguuggguu

SEQ ID NO: 1253 - RNA, 20 nt, Artificial Sequence
  Antisense Sequence
cauauugccaggugguuguu

SEQ ID NO: 1254 - RNA, 20 nt, Artificial Sequence
  Antisense Sequence
ucauauugccaggugguugu

SEQ ID NO: 1255 - RNA, 20 nt, Artificial Sequence
  Antisense Sequence
gucauauugccaggugguug

SEQ ID NO: 1256 - RNA, 20 nt, Artificial Sequence
  Antisense Sequence
agucauauugccaggugguu

SEQ ID NO: 1257 - RNA, 20 nt, Artificial Sequence
  Antisense Sequence
gagucauauugccagguggu

SEQ ID NO: 1258 - RNA, 20 nt, Artificial Sequence
  Antisense Sequence
agugagucauauugccaggu

SEQ ID NO: 1259 - RNA, 20 nt, Artificial Sequence
  Antisense Sequence
aagugagucauauugccagg

SEQ ID NO: 1260 - RNA, 20 nt, Artificial Sequence
  Antisense Sequence
caagugagucauauugccag

SEQ ID NO: 1261 - RNA, 20 nt, Artificial Sequence
  Antisense Sequence
gucaagugagucauauugcc

SEQ ID NO: 1262 - RNA, 20 nt, Artificial Sequence
  Antisense Sequence
ggucaagugagucauauugc

SEQ ID NO: 1263 - RNA, 20 nt, Artificial Sequence
  Antisense Sequence
gggucaagugagucauauug

SEQ ID NO: 1264 - RNA, 20 nt, Artificial Sequence
  Antisense Sequence
cccauuugggucccauaggg

SEQ ID NO: 1265 - RNA, 20 nt, Artificial Sequence
  Antisense Sequence
gcccauuugggucccauagg

SEQ ID NO: 1266 - RNA, 20 nt, Artificial Sequence
  Antisense Sequence
ugcccauuugggucccauag

SEQ ID NO: 1267 - RNA, 20 nt, Artificial Sequence
  Antisense Sequence
gugcccauuugggucccaua

SEQ ID NO: 1268 - RNA, 20 nt, Artificial Sequence
  Antisense Sequence
agugcccauuugggucccau

SEQ ID NO: 1269 - RNA, 20 nt, Artificial Sequence
  Antisense Sequence
aagugcccauuuggguccca

SEQ ID NO: 1270 - RNA, 20 nt, Artificial Sequence
  Antisense Sequence
aaagugcccauuuggguccc

SEQ ID NO: 1271 - RNA, 20 nt, Artificial Sequence
  Antisense Sequence
gaaagugcccauuugggucc

SEQ ID NO: 1272 - RNA, 20 nt, Artificial Sequence
  Antisense Sequence
agaaagugcccauuuggguc

SEQ ID NO: 1273 - RNA, 20 nt, Artificial Sequence
  Antisense Sequence
caagaaagugcccauuuggg

SEQ ID NO: 1274 - RNA, 20 nt, Artificial Sequence
  Antisense Sequence
acaagaaagugcccauuugg

SEQ ID NO: 1275 - RNA, 20 nt, Artificial Sequence
  Antisense Sequence
gacaagaaagugcccauuug

SEQ ID NO: 1276 - RNA, 20 nt, Artificial Sequence
  Antisense Sequence
gagucucagacaagaaagug

SEQ ID NO: 1277 - RNA, 20 nt, Artificial Sequence
  Antisense Sequence
ccagagucucagacaagaaa

SEQ ID NO: 1278 - RNA, 20 nt, Artificial Sequence
  Antisense Sequence
gccagagucucagacaagaa

SEQ ID NO: 1279 - RNA, 20 nt, Artificial Sequence
  Antisense Sequence
agccagagucucagacaaga

SEQ ID NO: 1280 - RNA, 20 nt, Artificial Sequence
  Antisense Sequence
uaagccagagucucagacaa

SEQ ID NO: 1281 - RNA, 20 nt, Artificial Sequence
  Antisense Sequence
auaagccagagucucagaca

SEQ ID NO: 1282 - RNA, 20 nt, Artificial Sequence
  Antisense Sequence
agccaaccuggaauaagcca

SEQ ID NO: 1283 - RNA, 20 nt, Artificial Sequence
  Antisense Sequence
ucagccaaccuggaauaagc

SEQ ID NO: 1284 - RNA, 20 nt, Artificial Sequence
  Antisense Sequence
caucagccaaccuggaauaa

SEQ ID NO: 1285 - RNA, 20 nt, Artificial Sequence
  Antisense Sequence
cacaucagccaaccuggaau

SEQ ID NO: 1286 - RNA, 20 nt, Artificial Sequence
  Antisense Sequence
acacaucagccaaccuggaa

SEQ ID NO: 1287 - RNA, 20 nt, Artificial Sequence
  Antisense Sequence
aacacaucagccaaccugga

SEQ ID NO: 1288 - RNA, 20 nt, Artificial Sequence
  Antisense Sequence
caacacaucagccaaccugg

SEQ ID NO: 1289 - RNA, 20 nt, Artificial Sequence
  Antisense Sequence
cucccaacacaucagccaac

SEQ ID NO: 1290 - RNA, 20 nt, Artificial Sequence
  Antisense Sequence
cgcuuuacccaucucccaac

SEQ ID NO: 1291 - RNA, 20 nt, Artificial Sequence
  Antisense Sequence
aacgcuuuacccaucuccca

SEQ ID NO: 1292 - RNA, 20 nt, Artificial Sequence
  Antisense Sequence
aaacgcuuuacccaucuccc

SEQ ID NO: 1293 - RNA, 20 nt, Artificial Sequence
  Antisense Sequence
agaaacgcuuuacccaucuc

SEQ ID NO: 1294 - RNA, 20 nt, Artificial Sequence
  Antisense Sequence
aagaaacgcuuuacccaucu

SEQ ID NO: 1295 - RNA, 20 nt, Artificial Sequence
  Antisense Sequence
gaagaaacgcuuuacccauc

SEQ ID NO: 1296 - RNA, 20 nt, Artificial Sequence
  Antisense Sequence
agaagaaacgcuuuacccau

SEQ ID NO: 1297 - RNA, 20 nt, Artificial Sequence
  Antisense Sequence
uagaagaaacgcuuuaccca

SEQ ID NO: 1298 - RNA, 20 nt, Artificial Sequence
  Antisense Sequence
uuagaagaaacgcuuuaccc

SEQ ID NO: 1299 - RNA, 20 nt, Artificial Sequence
  Antisense Sequence
aaucaugcuuucuggguaga

SEQ ID NO: 1300 - RNA, 20 nt, Artificial Sequence
  Antisense Sequence
cuuagggcaggaaaucaugc

SEQ ID NO: 1301 - RNA, 20 nt, Artificial Sequence
  Antisense Sequence
acuuagggcaggaaaucaug

SEQ ID NO: 1302 - RNA, 20 nt, Artificial Sequence
  Antisense Sequence
gacuuagggcaggaaaucau

SEQ ID NO: 1303 - RNA, 20 nt, Artificial Sequence
  Antisense Sequence
aggacuuagggcaggaaauc

SEQ ID NO: 1304 - RNA, 20 nt, Artificial Sequence
  Antisense Sequence
caggacuuagggcaggaaau

SEQ ID NO: 1305 - RNA, 20 nt, Artificial Sequence
  Antisense Sequence
acaggacuuagggcaggaaa

SEQ ID NO: 1306 - RNA, 20 nt, Artificial Sequence
  Antisense Sequence
ucucacaggacuuagggcag

SEQ ID NO: 1307 - RNA, 20 nt, Artificial Sequence
  Antisense Sequence
uucucacaggacuuagggca

SEQ ID NO: 1308 - RNA, 20 nt, Artificial Sequence
  Antisense Sequence
aucuucucacaggacuuagg

SEQ ID NO: 1309 - RNA, 20 nt, Artificial Sequence
  Antisense Sequence
caucuucucacaggacuuag

SEQ ID NO: 1310 - RNA, 20 nt, Artificial Sequence
  Antisense Sequence
uagucccugacaucuucuca

SEQ ID NO: 1311 - RNA, 20 nt, Artificial Sequence
  Antisense Sequence
cuagucccugacaucuucuc

SEQ ID NO: 1312 - RNA, 20 nt, Artificial Sequence
  Antisense Sequence
ccuagucccugacaucuucu

SEQ ID NO: 1313 - RNA, 20 nt, Artificial Sequence
  Antisense Sequence
cccuagucccugacaucuuc

SEQ ID NO: 1314 - RNA, 20 nt, Artificial Sequence
  Antisense Sequence
ucccuagucccugacaucuu

SEQ ID NO: 1315 - RNA, 20 nt, Artificial Sequence
  Antisense Sequence
cucccuagucccugacaucu

SEQ ID NO: 1316 - RNA, 20 nt, Artificial Sequence
  Antisense Sequence
aucuaucugcuuccuccucc

SEQ ID NO: 1317 - RNA, 20 nt, Artificial Sequence
  Antisense Sequence
ccaucuaucugcuuccuccu

SEQ ID NO: 1318 - RNA, 20 nt, Artificial Sequence
  Antisense Sequence
accaucuaucugcuuccucc

SEQ ID NO: 1319 - RNA, 20 nt, Artificial Sequence
  Antisense Sequence
gaccaucuaucugcuuccuc

SEQ ID NO: 1320 - RNA, 20 nt, Artificial Sequence
  Antisense Sequence
ggaccaucuaucugcuuccu

SEQ ID NO: 1321 - RNA, 20 nt, Artificial Sequence
  Antisense Sequence
uggaccaucuaucugcuucc

SEQ ID NO: 1322 - RNA, 20 nt, Artificial Sequence
  Antisense Sequence
cuggaccaucuaucugcuuc

SEQ ID NO: 1323 - RNA, 20 nt, Artificial Sequence
  Antisense Sequence
cugcuggaccaucuaucugc

SEQ ID NO: 1324 - RNA, 20 nt, Artificial Sequence
  Antisense Sequence
gccugcuggaccaucuaucu

SEQ ID NO: 1325 - RNA, 20 nt, Artificial Sequence
  Antisense Sequence
uucaagccugcuggaccauc

SEQ ID NO: 1326 - RNA, 20 nt, Artificial Sequence
  Antisense Sequence
ugcuucaagccugcuggacc

SEQ ID NO: 1327 - RNA, 20 nt, Artificial Sequence
  Antisense Sequence
ccucaacagcccuuacccug

SEQ ID NO: 1328 - RNA, 20 nt, Artificial Sequence
  Antisense Sequence
ucccucuugaccuucccuua

SEQ ID NO: 1329 - RNA, 20 nt, Artificial Sequence
  Antisense Sequence
cucccucuugaccuucccuu

SEQ ID NO: 1330 - RNA, 20 nt, Artificial Sequence
  Antisense Sequence
ucucccucuugaccuucccu

SEQ ID NO: 1331 - RNA, 20 nt, Artificial Sequence
  Antisense Sequence
caucucccucuugaccuucc

SEQ ID NO: 1332 - RNA, 20 nt, Artificial Sequence
  Antisense Sequence
ccaucucccucuugaccuuc

SEQ ID NO: 1333 - RNA, 20 nt, Artificial Sequence
  Antisense Sequence
cccaucucccucuugaccuu

SEQ ID NO: 1334 - RNA, 20 nt, Artificial Sequence
  Antisense Sequence
gcccaucucccucuugaccu

SEQ ID NO: 1335 - RNA, 20 nt, Artificial Sequence
  Antisense Sequence
uugcccaucucccucuugac

SEQ ID NO: 1336 - RNA, 20 nt, Artificial Sequence
  Antisense Sequence
cuugcccaucucccucuuga

SEQ ID NO: 1337 - RNA, 20 nt, Artificial Sequence
  Antisense Sequence
cccuaagcauccucccucag

SEQ ID NO: 1338 - RNA, 20 nt, Artificial Sequence
  Antisense Sequence
aacuucuuaggcuuagugcc

SEQ ID NO: 1339 - RNA, 20 nt, Artificial Sequence
  Antisense Sequence
ggaacuucuuaggcuuagug

SEQ ID NO: 1340 - RNA, 20 nt, Artificial Sequence
  Antisense Sequence
gggaacuucuuaggcuuagu

SEQ ID NO: 1341 - RNA, 20 nt, Artificial Sequence
  Antisense Sequence
agggaacuucuuaggcuuag

SEQ ID NO: 1342 - RNA, 20 nt, Artificial Sequence
  Antisense Sequence
ugucucccaguggguccugu

SEQ ID NO: 1343 - RNA, 20 nt, Artificial Sequence
  Antisense Sequence
aguauaaaugcuugucuccc

SEQ ID NO: 1344 - RNA, 20 nt, Artificial Sequence
  Antisense Sequence
gacagagcgagacucgaucu

SEQ ID NO: 1345 - RNA, 20 nt, Artificial Sequence
  Antisense Sequence
ugacagagcgagacucgauc

SEQ ID NO: 1346 - RNA, 20 nt, Artificial Sequence
  Antisense Sequence
gugacagagcgagacucgau

SEQ ID NO: 1347 - RNA, 20 nt, Artificial Sequence
  Antisense Sequence
ggugacagagcgagacucga

SEQ ID NO: 1348 - RNA, 20 nt, Artificial Sequence
  Antisense Sequence
uggugacagagcgagacucg

SEQ ID NO: 1349 - RNA, 20 nt, Artificial Sequence
  Antisense Sequence
cuggugacagagcgagacuc

SEQ ID NO: 1350 - RNA, 20 nt, Artificial Sequence
  Antisense Sequence
ccuggugacagagcgagacu

SEQ ID NO: 1351 - RNA, 20 nt, Artificial Sequence
  Antisense Sequence
agccuggugacagagcgaga

SEQ ID NO: 1352 - RNA, 20 nt, Artificial Sequence
  Antisense Sequence
ugcacuccagccuggugaca

SEQ ID NO: 1353 - RNA, 20 nt, Artificial Sequence
  Antisense Sequence
acugcacuccagccugguga

SEQ ID NO: 1354 - RNA, 20 nt, Artificial Sequence
  Antisense Sequence
ucacugcacuccagccuggu

SEQ ID NO: 1355 - RNA, 20 nt, Artificial Sequence
  Antisense Sequence
ugucacugcacuccagccug

SEQ ID NO: 1356 - RNA, 20 nt, Artificial Sequence
  Antisense Sequence
gugucacugcacuccagccu

SEQ ID NO: 1357 - RNA, 20 nt, Artificial Sequence
  Antisense Sequence
agacggagguugcagugagc

SEQ ID NO: 1358 - RNA, 20 nt, Artificial Sequence
  Antisense Sequence
gagacggagguugcagugag

SEQ ID NO: 1359 - RNA, 20 nt, Artificial Sequence
  Antisense Sequence
ggagacggagguugcaguga

SEQ ID NO: 1360 - RNA, 20 nt, Artificial Sequence
  Antisense Sequence
acuugaacccaggagacgga

SEQ ID NO: 1361 - RNA, 20 nt, Artificial Sequence
  Antisense Sequence
cacuugaacccaggagacgg

SEQ ID NO: 1362 - RNA, 20 nt, Artificial Sequence
  Antisense Sequence
ucacuugaacccaggagacg

SEQ ID NO: 1363 - RNA, 20 nt, Artificial Sequence
  Antisense Sequence
aucacuugaacccaggagac

SEQ ID NO: 1364 - RNA, 20 nt, Artificial Sequence
  Antisense Sequence
aaucacuugaacccaggaga

SEQ ID NO: 1365 - RNA, 20 nt, Artificial Sequence
  Antisense Sequence
gaaucacuugaacccaggag

SEQ ID NO: 1366 - RNA, 20 nt, Artificial Sequence
  Antisense Sequence
agaaucacuugaacccagga

SEQ ID NO: 1367 - RNA, 20 nt, Artificial Sequence
  Antisense Sequence
aagaaucacuugaacccagg

SEQ ID NO: 1368 - RNA, 20 nt, Artificial Sequence
  Antisense Sequence
gaagaaucacuugaacccag

SEQ ID NO: 1369 - RNA, 20 nt, Artificial Sequence
  Antisense Sequence
agaagaaucacuugaaccca

SEQ ID NO: 1370 - RNA, 20 nt, Artificial Sequence
  Antisense Sequence
cagaagaaucacuugaaccc

SEQ ID NO: 1371 - RNA, 20 nt, Artificial Sequence
  Antisense Sequence
gcagaagaaucacuugaacc

SEQ ID NO: 1372 - RNA, 20 nt, Artificial Sequence
  Antisense Sequence
ggcagaagaaucacuugaac

SEQ ID NO: 1373 - RNA, 20 nt, Artificial Sequence
  Antisense Sequence
aggcagaagaaucacuugaa

SEQ ID NO: 1374 - RNA, 20 nt, Artificial Sequence
  Antisense Sequence
gaggcagaagaaucacuuga

SEQ ID NO: 1375 - RNA, 20 nt, Artificial Sequence
  Antisense Sequence
ugaggcagaagaaucacuug

SEQ ID NO: 1376 - RNA, 20 nt, Artificial Sequence
  Antisense Sequence
cugaggcagaagaaucacuu

SEQ ID NO: 1377 - RNA, 20 nt, Artificial Sequence
  Antisense Sequence
gcugaggcagaagaaucacu

SEQ ID NO: 1378 - RNA, 20 nt, Artificial Sequence
  Antisense Sequence
ggcugaggcagaagaaucac

SEQ ID NO: 1379 - RNA, 20 nt, Artificial Sequence
  Antisense Sequence
aggcugaggcagaagaauca

SEQ ID NO: 1380 - RNA, 20 nt, Artificial Sequence
  Antisense Sequence
gaggcugaggcagaagaauc

SEQ ID NO: 1381 - RNA, 20 nt, Artificial Sequence
  Antisense Sequence
ggaggcugaggcagaagaau

SEQ ID NO: 1382 - RNA, 20 nt, Artificial Sequence
  Antisense Sequence
gggaggcugaggcagaagaa

SEQ ID NO: 1383 - RNA, 20 nt, Artificial Sequence
  Antisense Sequence
agauugagaccauccuggcc

SEQ ID NO: 1384 - RNA, 20 nt, Artificial Sequence
  Antisense Sequence
gagauugagaccauccuggc

SEQ ID NO: 1385 - RNA, 20 nt, Artificial Sequence
  Antisense Sequence
agagauugagaccauccugg

SEQ ID NO: 1386 - RNA, 20 nt, Artificial Sequence
  Antisense Sequence
aagagauugagaccauccug

SEQ ID NO: 1387 - RNA, 20 nt, Artificial Sequence
  Antisense Sequence
caagagauugagaccauccu

SEQ ID NO: 1388 - RNA, 20 nt, Artificial Sequence
  Antisense Sequence
gguggcucacgccuauaauc

SEQ ID NO: 1389 - RNA, 20 nt, Artificial Sequence
  Antisense Sequence
cgguggcucacgccuauaau

SEQ ID NO: 1390 - RNA, 20 nt, Artificial Sequence
  Antisense Sequence
gcgguggcucacgccuauaa

SEQ ID NO: 1391 - RNA, 20 nt, Artificial Sequence
  Antisense Sequence
cccuaacccuucuuuaugac

SEQ ID NO: 1392 - RNA, 20 nt, Artificial Sequence
  Antisense Sequence
cacccuaacccuucuuuaug

SEQ ID NO: 1393 - RNA, 20 nt, Artificial Sequence
  Antisense Sequence
aucacccuaacccuucuuua

SEQ ID NO: 1394 - RNA, 20 nt, Artificial Sequence
  Antisense Sequence
caucacccuaacccuucuuu

SEQ ID NO: 1395 - RNA, 20 nt, Artificial Sequence
  Antisense Sequence
ccaucacccuaacccuucuu

SEQ ID NO: 1396 - RNA, 20 nt, Artificial Sequence
  Antisense Sequence
gaccaucacccuaacccuuc

SEQ ID NO: 1397 - RNA, 20 nt, Artificial Sequence
  Antisense Sequence
ggaccaucacccuaacccuu

SEQ ID NO: 1398 - RNA, 20 nt, Artificial Sequence
  Antisense Sequence
uggaccaucacccuaacccu

SEQ ID NO: 1399 - RNA, 20 nt, Artificial Sequence
  Antisense Sequence
cuggaccaucacccuaaccc

SEQ ID NO: 1400 - RNA, 20 nt, Artificial Sequence
  Antisense Sequence
ucuggaccaucacccuaacc

SEQ ID NO: 1401 - RNA, 20 nt, Artificial Sequence
  Antisense Sequence
cucuggaccaucacccuaac

SEQ ID NO: 1402 - RNA, 20 nt, Artificial Sequence
  Antisense Sequence
gcucuggaccaucacccuaa

SEQ ID NO: 1403 - RNA, 20 nt, Artificial Sequence
  Antisense Sequence
ugcucuggaccaucacccua

SEQ ID NO: 1404 - RNA, 20 nt, Artificial Sequence
  Antisense Sequence
guugcucuggaccaucaccc

SEQ ID NO: 1405 - RNA, 20 nt, Artificial Sequence
  Antisense Sequence
uguugcucuggaccaucacc

SEQ ID NO: 1406 - RNA, 20 nt, Artificial Sequence
  Antisense Sequence
acuguugcucuggaccauca

SEQ ID NO: 1407 - RNA, 20 nt, Artificial Sequence
  Antisense Sequence
aacuguugcucuggaccauc

SEQ ID NO: 1408 - RNA, 20 nt, Artificial Sequence
  Antisense Sequence
gaacuguugcucuggaccau

SEQ ID NO: 1409 - RNA, 20 nt, Artificial Sequence
  Antisense Sequence
gaagaacuguugcucuggac

SEQ ID NO: 1410 - RNA, 20 nt, Artificial Sequence
  Antisense Sequence
uugaagaacuguugcucugg

SEQ ID NO: 1411 - RNA, 20 nt, Artificial Sequence
  Antisense Sequence
acuugaagaacuguugcucu

SEQ ID NO: 1412 - RNA, 20 nt, Artificial Sequence
  Antisense Sequence
cacuugaagaacuguugcuc

SEQ ID NO: 1413 - RNA, 20 nt, Artificial Sequence
  Antisense Sequence
uacacuugaagaacuguugc

SEQ ID NO: 1414 - RNA, 20 nt, Artificial Sequence
  Antisense Sequence
gaguacacuugaagaacugu

SEQ ID NO: 1415 - RNA, 20 nt, Artificial Sequence
  Antisense Sequence
agaguacacuugaagaacug

SEQ ID NO: 1416 - RNA, 20 nt, Artificial Sequence
  Antisense Sequence
cagaguacacuugaagaacu

SEQ ID NO: 1417 - RNA, 20 nt, Artificial Sequence
  Antisense Sequence
acagaguacacuugaagaac

SEQ ID NO: 1418 - RNA, 20 nt, Artificial Sequence
  Antisense Sequence
cuacagaguacacuugaaga

SEQ ID NO: 1419 - RNA, 20 nt, Artificial Sequence
  Antisense Sequence
ccuacagaguacacuugaag

SEQ ID NO: 1420 - RNA, 20 nt, Artificial Sequence
  Antisense Sequence
gccuacagaguacacuugaa

SEQ ID NO: 1421 - RNA, 20 nt, Artificial Sequence
  Antisense Sequence
agccuacagaguacacuuga

SEQ ID NO: 1422 - RNA, 20 nt, Artificial Sequence
  Antisense Sequence
aagccuacagaguacacuug

SEQ ID NO: 1423 - RNA, 20 nt, Artificial Sequence
  Antisense Sequence
cagaagccuacagaguacac

SEQ ID NO: 1424 - RNA, 20 nt, Artificial Sequence
  Antisense Sequence
ccagaagccuacagaguaca

SEQ ID NO: 1425 - RNA, 20 nt, Artificial Sequence
  Antisense Sequence
aaaagggaccucccagaagc

SEQ ID NO: 1426 - RNA, 20 nt, Artificial Sequence
  Antisense Sequence
gaaaagggaccucccagaag

SEQ ID NO: 1427 - RNA, 20 nt, Artificial Sequence
  Antisense Sequence
ugaaaagggaccucccagaa

SEQ ID NO: 1428 - RNA, 20 nt, Artificial Sequence
  Antisense Sequence
cuuugacuuuguggacaccc

SEQ ID NO: 1429 - RNA, 20 nt, Artificial Sequence
  Antisense Sequence
gcuuugacuuuguggacacc

SEQ ID NO: 1430 - RNA, 20 nt, Artificial Sequence
  Antisense Sequence
uagcuuugacuuuguggaca

SEQ ID NO: 1431 - RNA, 20 nt, Artificial Sequence
  Antisense Sequence
auagcuuugacuuuguggac

SEQ ID NO: 1432 - RNA, 20 nt, Artificial Sequence
  Antisense Sequence
gucacacggccucuggaaaa

SEQ ID NO: 1433 - RNA, 20 nt, Artificial Sequence
  Antisense Sequence
ugucacacggccucuggaaa

SEQ ID NO: 1434 - RNA, 20 nt, Artificial Sequence
  Antisense Sequence
augucacacggccucuggaa

SEQ ID NO: 1435 - RNA, 20 nt, Artificial Sequence
  Antisense Sequence
aagaccauacaagcacacau

SEQ ID NO: 1436 - RNA, 20 nt, Artificial Sequence
  Antisense Sequence
acaagaccauacaagcacac

SEQ ID NO: 1437 - RNA, 20 nt, Artificial Sequence
  Antisense Sequence
cacaagaccauacaagcaca

SEQ ID NO: 1438 - RNA, 20 nt, Artificial Sequence
  Antisense Sequence
aacacaagaccauacaagca

SEQ ID NO: 1439 - RNA, 20 nt, Artificial Sequence
  Antisense Sequence
uaacacaagaccauacaagc

SEQ ID NO: 1440 - RNA, 20 nt, Artificial Sequence
  Antisense Sequence
acuguaacacaagaccauac

SEQ ID NO: 1441 - RNA, 20 nt, Artificial Sequence
  Antisense Sequence
agacuguaacacaagaccau

SEQ ID NO: 1442 - RNA, 20 nt, Artificial Sequence
  Antisense Sequence
aagacuguaacacaagacca

SEQ ID NO: 1443 - RNA, 20 nt, Artificial Sequence
  Antisense Sequence
gccgagauugugccacugca

SEQ ID NO: 1444 - RNA, 20 nt, Artificial Sequence
  Antisense Sequence
agccgagauugugccacugc

SEQ ID NO: 1445 - RNA, 20 nt, Artificial Sequence
  Antisense Sequence
gagccgagauugugccacug

SEQ ID NO: 1446 - RNA, 20 nt, Artificial Sequence
  Antisense Sequence
ugagccgagauugugccacu

SEQ ID NO: 1447 - RNA, 20 nt, Artificial Sequence
  Antisense Sequence
gugagccgagauugugccac

SEQ ID NO: 1448 - RNA, 20 nt, Artificial Sequence
  Antisense Sequence
agugagccgagauugugcca

SEQ ID NO: 1449 - RNA, 20 nt, Artificial Sequence
  Antisense Sequence
cagugagccgagauugugcc

SEQ ID NO: 1450 - RNA, 20 nt, Artificial Sequence
  Antisense Sequence
gcagugagccgagauugugc

SEQ ID NO: 1451 - RNA, 20 nt, Artificial Sequence
  Antisense Sequence
ugcagugagccgagauugug

SEQ ID NO: 1452 - RNA, 20 nt, Artificial Sequence
  Antisense Sequence
uugcagugagccgagauugu

SEQ ID NO: 1453 - RNA, 20 nt, Artificial Sequence
  Antisense Sequence
guugcagugagccgagauug

SEQ ID NO: 1454 - RNA, 20 nt, Artificial Sequence
  Antisense Sequence
gguugcagugagccgagauu

SEQ ID NO: 1455 - RNA, 20 nt, Artificial Sequence
  Antisense Sequence
agguugcagugagccgagau

SEQ ID NO: 1456 - RNA, 20 nt, Artificial Sequence
  Antisense Sequence
gagguugcagugagccgaga

SEQ ID NO: 1457 - RNA, 20 nt, Artificial Sequence
  Antisense Sequence
uggagguugcagugagccga

SEQ ID NO: 1458 - RNA, 20 nt, Artificial Sequence
  Antisense Sequence
agguggagguugcagugagc

SEQ ID NO: 1459 - RNA, 20 nt, Artificial Sequence
  Antisense Sequence
gagguggagguugcagugag

SEQ ID NO: 1460 - RNA, 20 nt, Artificial Sequence
  Antisense Sequence
ggagguggagguugcaguga

SEQ ID NO: 1461 - RNA, 20 nt, Artificial Sequence
  Antisense Sequence
ugggagguggagguugcagu

SEQ ID NO: 1462 - RNA, 20 nt, Artificial Sequence
  Antisense Sequence
ucccagcuacucaggaggcu

SEQ ID NO: 1463 - RNA, 20 nt, Artificial Sequence
  Antisense Sequence
agucccagcuacucaggagg

SEQ ID NO: 1464 - RNA, 20 nt, Artificial Sequence
  Antisense Sequence
uagucccagcuacucaggag

SEQ ID NO: 1465 - RNA, 20 nt, Artificial Sequence
  Antisense Sequence
aaauagcugggcaugguggc

SEQ ID NO: 1466 - RNA, 20 nt, Artificial Sequence
  Antisense Sequence
aaaauagcugggcauggugg

SEQ ID NO: 1467 - RNA, 20 nt, Artificial Sequence
  Antisense Sequence
gcaggcggaucaccucaagu

SEQ ID NO: 1468 - RNA, 20 nt, Artificial Sequence
  Antisense Sequence
aggcaggcggaucaccucaa

SEQ ID NO: 1469 - RNA, 20 nt, Artificial Sequence
  Antisense Sequence
aaggcaggcggaucaccuca

SEQ ID NO: 1470 - RNA, 20 nt, Artificial Sequence
  Antisense Sequence
cuguaaucccagcacuuugg

SEQ ID NO: 1471 - RNA, 20 nt, Artificial Sequence
  Antisense Sequence
ccuguaaucccagcacuuug

SEQ ID NO: 1472 - RNA, 20 nt, Artificial Sequence
  Antisense Sequence
accuguaaucccagcacuuu

SEQ ID NO: 1473 - RNA, 20 nt, Artificial Sequence
  Antisense Sequence
gaccuguaaucccagcacuu

SEQ ID NO: 1474 - RNA, 20 nt, Artificial Sequence
  Antisense Sequence
agaccuguaaucccagcacu

SEQ ID NO: 1475 - RNA, 20 nt, Artificial Sequence
  Antisense Sequence
cagaccuguaaucccagcac

SEQ ID NO: 1476 - RNA, 20 nt, Artificial Sequence
  Antisense Sequence
ucagaccuguaaucccagca

SEQ ID NO: 1477 - RNA, 20 nt, Artificial Sequence
  Antisense Sequence
cucagaccuguaaucccagc

SEQ ID NO: 1478 - RNA, 20 nt, Artificial Sequence
  Antisense Sequence
aggcacaguggcucagaccu

SEQ ID NO: 1479 - RNA, 20 nt, Artificial Sequence
  Antisense Sequence
uaggcacaguggcucagacc

SEQ ID NO: 1480 - RNA, 20 nt, Artificial Sequence
  Antisense Sequence
uuaggcacaguggcucagac

SEQ ID NO: 1481 - RNA, 20 nt, Artificial Sequence
  Antisense Sequence
guuaggcacaguggcucaga

SEQ ID NO: 1482 - RNA, 20 nt, Artificial Sequence
  Antisense Sequence
gguuaggcacaguggcucag

SEQ ID NO: 1483 - RNA, 20 nt, Artificial Sequence
  Antisense Sequence
agguuaggcacaguggcuca

SEQ ID NO: 1484 - RNA, 20 nt, Artificial Sequence
  Antisense Sequence
auuagguuaggcacaguggc

SEQ ID NO: 1485 - RNA, 20 nt, Artificial Sequence
  Antisense Sequence
gucauuagguuaggcacagu

SEQ ID NO: 1486 - RNA, 20 nt, Artificial Sequence
  Antisense Sequence
agucauuagguuaggcacag

SEQ ID NO: 1487 - RNA, 20 nt, Artificial Sequence
  Antisense Sequence
aagucauuagguuaggcaca

SEQ ID NO: 1488 - RNA, 20 nt, Artificial Sequence
  Antisense Sequence
aaagucauuagguuaggcac

SEQ ID NO: 1489 - RNA, 20 nt, Artificial Sequence
  Antisense Sequence
gaacaccuuacuuucuucuc

SEQ ID NO: 1490 - RNA, 20 nt, Artificial Sequence
  Antisense Sequence
agcucucuuagaacaccuua

SEQ ID NO: 1491 - RNA, 20 nt, Artificial Sequence
  Antisense Sequence
ggugcccagcaagaagagcu

SEQ ID NO: 1492 - RNA, 20 nt, Artificial Sequence
  Antisense Sequence
gguuuaagcggucuuccggc

SEQ ID NO: 1493 - RNA, 20 nt, Artificial Sequence
  Antisense Sequence
ggguuuaagcggucuuccgg

SEQ ID NO: 1494 - RNA, 20 nt, Artificial Sequence
  Antisense Sequence
uggguuuaagcggucuuccg

SEQ ID NO: 1495 - RNA, 20 nt, Artificial Sequence
  Antisense Sequence
cuggguuuaagcggucuucc

SEQ ID NO: 1496 - RNA, 20 nt, Artificial Sequence
  Antisense Sequence
cauagccucgaacuccuggg

SEQ ID NO: 1497 - RNA, 20 nt, Artificial Sequence
  Antisense Sequence
ucauagccucgaacuccugg

SEQ ID NO: 1498 - RNA, 20 nt, Artificial Sequence
  Antisense Sequence
aucauagccucgaacuccug

SEQ ID NO: 1499 - RNA, 20 nt, Artificial Sequence
  Antisense Sequence
gaucauagccucgaacuccu

SEQ ID NO: 1500 - RNA, 20 nt, Artificial Sequence
  Antisense Sequence
gcagaggcuauucacaagug

SEQ ID NO: 1501 - RNA, 20 nt, Artificial Sequence
  Antisense Sequence
ugcagaggcuauucacaagu

SEQ ID NO: 1502 - RNA, 20 nt, Artificial Sequence
  Antisense Sequence
gugcagaggcuauucacaag

SEQ ID NO: 1503 - RNA, 20 nt, Artificial Sequence
  Antisense Sequence
agugcagaggcuauucacaa

SEQ ID NO: 1504 - RNA, 20 nt, Artificial Sequence
  Antisense Sequence
aggcuggagugcagaggcua

SEQ ID NO: 1505 - RNA, 20 nt, Artificial Sequence
  Antisense Sequence
uuugcccaggcuggagugca

SEQ ID NO: 1506 - RNA, 20 nt, Artificial Sequence
  Antisense Sequence
auuugcccaggcuggagugc

SEQ ID NO: 1507 - RNA, 20 nt, Artificial Sequence
  Antisense Sequence
uauuugcccaggcuggagug

SEQ ID NO: 1508 - RNA, 20 nt, Artificial Sequence
  Antisense Sequence
cuauuugcccaggcuggagu

SEQ ID NO: 1509 - RNA, 20 nt, Artificial Sequence
  Antisense Sequence
acuauuugcccaggcuggag

SEQ ID NO: 1510 - RNA, 20 nt, Artificial Sequence
  Antisense Sequence
ccagaggagcuauuuaugua

SEQ ID NO: 1511 - RNA, 20 nt, Artificial Sequence
  Antisense Sequence
agacuaaugggcacugaaaa

SEQ ID NO: 1512 - RNA, 20 nt, Artificial Sequence
  Antisense Sequence
gaccagacuaaugggcacug

SEQ ID NO: 1513 - RNA, 20 nt, Artificial Sequence
  Antisense Sequence
cagaccagacuaaugggcac

SEQ ID NO: 1514 - RNA, 20 nt, Artificial Sequence
  Antisense Sequence
gucagaccagacuaaugggc

SEQ ID NO: 1515 - RNA, 20 nt, Artificial Sequence
  Antisense Sequence
ccagcucagucagaccagac

SEQ ID NO: 1516 - RNA, 20 nt, Artificial Sequence
  Antisense Sequence
cccagcucagucagaccaga

SEQ ID NO: 1517 - RNA, 20 nt, Artificial Sequence
  Antisense Sequence
gacccagcucagucagacca

SEQ ID NO: 1518 - RNA, 20 nt, Artificial Sequence
  Antisense Sequence
agacccagcucagucagacc

SEQ ID NO: 1519 - RNA, 20 nt, Artificial Sequence
  Antisense Sequence
agagacccagcucagucaga

SEQ ID NO: 1520 - RNA, 20 nt, Artificial Sequence
  Antisense Sequence
ucagagacccagcucaguca

SEQ ID NO: 1521 - RNA, 20 nt, Artificial Sequence
  Antisense Sequence
ugacccaggcuaguuauccc

SEQ ID NO: 1522 - RNA, 20 nt, Artificial Sequence
  Antisense Sequence
uugacccaggcuaguuaucc

SEQ ID NO: 1523 - RNA, 20 nt, Artificial Sequence
  Antisense Sequence
uuugacccaggcuaguuauc

SEQ ID NO: 1524 - RNA, 20 nt, Artificial Sequence
  Antisense Sequence
cuuugacccaggcuaguuau

SEQ ID NO: 1525 - RNA, 20 nt, Artificial Sequence
  Antisense Sequence
acuuugacccaggcuaguua

SEQ ID NO: 1526 - RNA, 20 nt, Artificial Sequence
  Antisense Sequence
gacuuugacccaggcuaguu

SEQ ID NO: 1527 - RNA, 20 nt, Artificial Sequence
  Antisense Sequence
ggacuuugacccaggcuagu

SEQ ID NO: 1528 - RNA, 20 nt, Artificial Sequence
  Antisense Sequence
uucagucugagggucaaggg

SEQ ID NO: 1529 - RNA, 20 nt, Artificial Sequence
  Antisense Sequence
guucagucugagggucaagg

SEQ ID NO: 1530 - RNA, 20 nt, Artificial Sequence
  Antisense Sequence
uguucagucugagggucaag

SEQ ID NO: 1531 - RNA, 20 nt, Artificial Sequence
  Antisense Sequence
cuguucagucugagggucaa

SEQ ID NO: 1532 - RNA, 20 nt, Artificial Sequence
  Antisense Sequence
acuguucagucugaggguca

SEQ ID NO: 1533 - RNA, 20 nt, Artificial Sequence
  Antisense Sequence
aacuguucagucugaggguc

SEQ ID NO: 1534 - RNA, 20 nt, Artificial Sequence
  Antisense Sequence
uaacuguucagucugagggu

SEQ ID NO: 1535 - RNA, 20 nt, Artificial Sequence
  Antisense Sequence
uuaacuguucagucugaggg

SEQ ID NO: 1536 - RNA, 20 nt, Artificial Sequence
  Antisense Sequence
guggaaggucaguggguuaa

SEQ ID NO: 1537 - RNA, 20 nt, Artificial Sequence
  Antisense Sequence
guguggaaggucaguggguu

SEQ ID NO: 1538 - RNA, 20 nt, Artificial Sequence
  Antisense Sequence
gguguggaaggucagugggu

SEQ ID NO: 1539 - RNA, 20 nt, Artificial Sequence
  Antisense Sequence
uggguguggaaggucagugg

SEQ ID NO: 1540 - RNA, 20 nt, Artificial Sequence
  Antisense Sequence
uuggguguggaaggucagug

SEQ ID NO: 1541 - RNA, 20 nt, Artificial Sequence
  Antisense Sequence
ucugcuuccaagaaccaccc

SEQ ID NO: 1542 - RNA, 20 nt, Artificial Sequence
  Antisense Sequence
gcucugcuuccaagaaccac

SEQ ID NO: 1543 - RNA, 20 nt, Artificial Sequence
  Antisense Sequence
agcucugcuuccaagaacca

SEQ ID NO: 1544 - RNA, 20 nt, Artificial Sequence
  Antisense Sequence
uagcucugcuuccaagaacc

SEQ ID NO: 1545 - RNA, 20 nt, Artificial Sequence
  Antisense Sequence
ccuagcucugcuuccaagaa

SEQ ID NO: 1546 - RNA, 20 nt, Artificial Sequence
  Antisense Sequence
acauccuagcucugcuucca

SEQ ID NO: 1547 - RNA, 20 nt, Artificial Sequence
  Antisense Sequence
accucccacauccuagcucu

SEQ ID NO: 1548 - RNA, 20 nt, Artificial Sequence
  Antisense Sequence
gaccucccacauccuagcuc

SEQ ID NO: 1549 - RNA, 20 nt, Artificial Sequence
  Antisense Sequence
agaccucccacauccuagcu

SEQ ID NO: 1550 - RNA, 20 nt, Artificial Sequence
  Antisense Sequence
cagaccucccacauccuagc

SEQ ID NO: 1551 - RNA, 20 nt, Artificial Sequence
  Antisense Sequence
gcagaccucccacauccuag

SEQ ID NO: 1552 - RNA, 20 nt, Artificial Sequence
  Antisense Sequence
ggcagaccucccacauccua

SEQ ID NO: 1553 - RNA, 20 nt, Artificial Sequence
  Antisense Sequence
aggcagaccucccacauccu

SEQ ID NO: 1554 - RNA, 20 nt, Artificial Sequence
  Antisense Sequence
acaggcagaccucccacauc

SEQ ID NO: 1555 - RNA, 20 nt, Artificial Sequence
  Antisense Sequence
cacaggcagaccucccacau

SEQ ID NO: 1556 - RNA, 20 nt, Artificial Sequence
  Antisense Sequence
ggaggaagcaugacaaggaa

SEQ ID NO: 1557 - RNA, 20 nt, Artificial Sequence
  Antisense Sequence
aagaggaggaagcaugacaa

SEQ ID NO: 1558 - RNA, 20 nt, Artificial Sequence
  Antisense Sequence
gggcagcauuucagucucug

SEQ ID NO: 1559 - RNA, 20 nt, Artificial Sequence
  Antisense Sequence
gauuugcauugccaucguga

SEQ ID NO: 1560 - RNA, 20 nt, Artificial Sequence
  Antisense Sequence
agauuugcauugccaucgug

SEQ ID NO: 1561 - RNA, 20 nt, Artificial Sequence
  Antisense Sequence
cucuuuagauuugcauugcc

SEQ ID NO: 1562 - RNA, 20 nt, Artificial Sequence
  Antisense Sequence
ccucuuuagauuugcauugc

SEQ ID NO: 1563 - RNA, 20 nt, Artificial Sequence
  Antisense Sequence
gccucuuuagauuugcauug

SEQ ID NO: 1564 - RNA, 20 nt, Artificial Sequence
  Antisense Sequence
aagugcccugccucuuuaga

SEQ ID NO: 1565 - RNA, 20 nt, Artificial Sequence
  Antisense Sequence
gaagugcccugccucuuuag

SEQ ID NO: 1566 - RNA, 20 nt, Artificial Sequence
  Antisense Sequence
gggaagugcccugccucuuu

SEQ ID NO: 1567 - RNA, 20 nt, Artificial Sequence
  Antisense Sequence
acugccugacagggaagugc

SEQ ID NO: 1568 - RNA, 20 nt, Artificial Sequence
  Antisense Sequence
guacugccugacagggaagu

SEQ ID NO: 1569 - RNA, 20 nt, Artificial Sequence
  Antisense Sequence
gguacugccugacagggaag

SEQ ID NO: 1570 - RNA, 20 nt, Artificial Sequence
  Antisense Sequence
cgguacugccugacagggaa

SEQ ID NO: 1571 - RNA, 20 nt, Artificial Sequence
  Antisense Sequence
uaugcccagcgguacugccu

SEQ ID NO: 1572 - RNA, 20 nt, Artificial Sequence
  Antisense Sequence
ugcuaugcccagcgguacug

SEQ ID NO: 1573 - RNA, 20 nt, Artificial Sequence
  Antisense Sequence
uugcuaugcccagcgguacu

SEQ ID NO: 1574 - RNA, 20 nt, Artificial Sequence
  Antisense Sequence
guugcuaugcccagcgguac

SEQ ID NO: 1575 - RNA, 20 nt, Artificial Sequence
  Antisense Sequence
gguugcuaugcccagcggua

SEQ ID NO: 1576 - RNA, 20 nt, Artificial Sequence
  Antisense Sequence
agguugcuaugcccagcggu

SEQ ID NO: 1577 - RNA, 20 nt, Artificial Sequence
  Antisense Sequence
agagguugcuaugcccagcg

SEQ ID NO: 1578 - RNA, 20 nt, Artificial Sequence
  Antisense Sequence
agaggcagagguugcuaugc

SEQ ID NO: 1579 - RNA, 20 nt, Artificial Sequence
  Antisense Sequence
gagaggcagagguugcuaug

SEQ ID NO: 1580 - RNA, 20 nt, Artificial Sequence
  Antisense Sequence
ggagaggcagagguugcuau

SEQ ID NO: 1581 - RNA, 20 nt, Artificial Sequence
  Antisense Sequence
cggagaggcagagguugcua

SEQ ID NO: 1582 - RNA, 20 nt, Artificial Sequence
  Antisense Sequence
aacggagaggcagagguugc

SEQ ID NO: 1583 - RNA, 20 nt, Artificial Sequence
  Antisense Sequence
gagaaacggagaggcagagg

SEQ ID NO: 1584 - RNA, 20 nt, Artificial Sequence
  Antisense Sequence
ugagaaacggagaggcagag

SEQ ID NO: 1585 - RNA, 20 nt, Artificial Sequence
  Antisense Sequence
ucugagaaacggagaggcag

SEQ ID NO: 1586 - RNA, 20 nt, Artificial Sequence
  Antisense Sequence
aggagguggauaugugagcu

SEQ ID NO: 1587 - RNA, 20 nt, Artificial Sequence
  Antisense Sequence
cccaggagguggauauguga

SEQ ID NO: 1588 - RNA, 20 nt, Artificial Sequence
  Antisense Sequence
agcccaggagguggauaugu

SEQ ID NO: 1589 - RNA, 20 nt, Artificial Sequence
  Antisense Sequence
aagcccaggagguggauaug

SEQ ID NO: 1590 - RNA, 20 nt, Artificial Sequence
  Antisense Sequence
aaagcccaggagguggauau

SEQ ID NO: 1591 - RNA, 20 nt, Artificial Sequence
  Antisense Sequence
aaaagcccaggagguggaua

SEQ ID NO: 1592 - RNA, 20 nt, Artificial Sequence
  Antisense Sequence
uaaaagcccaggagguggau

SEQ ID NO: 1593 - RNA, 20 nt, Artificial Sequence
  Antisense Sequence
uuaaaagcccaggaggugga

SEQ ID NO: 1594 - RNA, 20 nt, Artificial Sequence
  Antisense Sequence
gcccacuuaaaagcccagga

SEQ ID NO: 1595 - RNA, 20 nt, Artificial Sequence
  Antisense Sequence
agcccacuuaaaagcccagg

SEQ ID NO: 1596 - RNA, 20 nt, Artificial Sequence
  Antisense Sequence
aagcccacuuaaaagcccag

SEQ ID NO: 1597 - RNA, 20 nt, Artificial Sequence
  Antisense Sequence
aaagcccacuuaaaagccca

SEQ ID NO: 1598 - RNA, 20 nt, Artificial Sequence
  Antisense Sequence
uaaagcccacuuaaaagccc

SEQ ID NO: 1599 - RNA, 20 nt, Artificial Sequence
  Antisense Sequence
cuaaagcccacuuaaaagcc

SEQ ID NO: 1600 - RNA, 20 nt, Artificial Sequence
  Antisense Sequence
cacuaaagcccacuuaaaag

SEQ ID NO: 1601 - RNA, 20 nt, Artificial Sequence
  Antisense Sequence
ccucacuaaagcccacuuaa

SEQ ID NO: 1602 - RNA, 20 nt, Artificial Sequence
  Antisense Sequence
cccucacuaaagcccacuua

SEQ ID NO: 1603 - RNA, 20 nt, Artificial Sequence
  Antisense Sequence
ggagcccaguugaaggagga

SEQ ID NO: 1604 - RNA, 20 nt, Artificial Sequence
  Antisense Sequence
aggagcccaguugaaggagg

SEQ ID NO: 1605 - RNA, 20 nt, Artificial Sequence
  Antisense Sequence
ggaggagcccaguugaagga

SEQ ID NO: 1606 - RNA, 20 nt, Artificial Sequence
  Antisense Sequence
aggaggagcccaguugaagg

SEQ ID NO: 1607 - RNA, 20 nt, Artificial Sequence
  Antisense Sequence
agucgaagcagaagagcugg

SEQ ID NO: 1608 - RNA, 20 nt, Artificial Sequence
  Antisense Sequence
gagucgaagcagaagagcug

SEQ ID NO: 1609 - RNA, 20 nt, Artificial Sequence
  Antisense Sequence
ggagucgaagcagaagagcu

SEQ ID NO: 1610 - RNA, 20 nt, Artificial Sequence
  Antisense Sequence
cggagucgaagcagaagagc

SEQ ID NO: 1611 - RNA, 20 nt, Artificial Sequence
  Antisense Sequence
ucggagucgaagcagaagag

SEQ ID NO: 1612 - RNA, 20 nt, Artificial Sequence
  Antisense Sequence
cucggagucgaagcagaaga

SEQ ID NO: 1613 - RNA, 20 nt, Artificial Sequence
  Antisense Sequence
gcucggagucgaagcagaag

SEQ ID NO: 1614 - RNA, 20 nt, Artificial Sequence
  Antisense Sequence
cgcucggagucgaagcagaa

SEQ ID NO: 1615 - RNA, 20 nt, Artificial Sequence
  Antisense Sequence
acaugacacccgcucggagu

SEQ ID NO: 1616 - RNA, 20 nt, Artificial Sequence
  Antisense Sequence
acacaugacacccgcucgga

SEQ ID NO: 1617 - RNA, 20 nt, Artificial Sequence
  Antisense Sequence
ucacacaugacacccgcucg

SEQ ID NO: 1618 - RNA, 20 nt, Artificial Sequence
  Antisense Sequence
cucacacaugacacccgcuc

SEQ ID NO: 1619 - RNA, 20 nt, Artificial Sequence
  Antisense Sequence
ucucacacaugacacccgcu

SEQ ID NO: 1620 - RNA, 20 nt, Artificial Sequence
  Antisense Sequence
uucucacacaugacacccgc

SEQ ID NO: 1621 - RNA, 20 nt, Artificial Sequence
  Antisense Sequence
guucucacacaugacacccg

SEQ ID NO: 1622 - RNA, 20 nt, Artificial Sequence
  Antisense Sequence
cguucucacacaugacaccc

SEQ ID NO: 1623 - RNA, 20 nt, Artificial Sequence
  Antisense Sequence
uggccguucucacacaugac

SEQ ID NO: 1624 - RNA, 20 nt, Artificial Sequence
  Antisense Sequence
cuggccguucucacacauga

SEQ ID NO: 1625 - RNA, 20 nt, Artificial Sequence
  Antisense Sequence
gcuggccguucucacacaug

SEQ ID NO: 1626 - RNA, 20 nt, Artificial Sequence
  Antisense Sequence
ugcuggccguucucacacau

SEQ ID NO: 1627 - RNA, 20 nt, Artificial Sequence
  Antisense Sequence
cugcuggccguucucacaca

SEQ ID NO: 1628 - RNA, 20 nt, Artificial Sequence
  Antisense Sequence
ucugcuggccguucucacac

SEQ ID NO: 1629 - RNA, 20 nt, Artificial Sequence
  Antisense Sequence
cucugcuggccguucucaca

SEQ ID NO: 1630 - RNA, 19 nt, Artificial Sequence
  siRNA Sense Sequence
guagccagacaugagcugu

SEQ ID NO: 1631 - RNA, 19 nt, Artificial Sequence
  siRNA Antisense Sequence
acagcucaugucuggcuac

SEQ ID NO: 1632 - RNA, 19 nt, Artificial Sequence
  siRNA Sense Sequence
agacaugagcugugagggu

SEQ ID NO: 1633 - RNA, 19 nt, Artificial Sequence
  siRNA Antisense Sequence
acccucacagcucaugucu

SEQ ID NO: 1634 - RNA, 19 nt, Artificial Sequence
  siRNA Sense Sequence
augagcugugagggucaag

SEQ ID NO: 1635 - RNA, 19 nt, Artificial Sequence
  siRNA Antisense Sequence
cuugacccucacagcucau

SEQ ID NO: 1636 - RNA, 19 nt, Artificial Sequence
  siRNA Sense Sequence
ugagcugugagggucaagc

SEQ ID NO: 1637 - RNA, 19 nt, Artificial Sequence
  siRNA Antisense Sequence
gcuugacccucacagcuca

SEQ ID NO: 1638 - RNA, 19 nt, Artificial Sequence
  siRNA Sense Sequence
gagcugugagggucaagca

SEQ ID NO: 1639 - RNA, 19 nt, Artificial Sequence
  siRNA Antisense Sequence
ugcuugacccucacagcuc

SEQ ID NO: 1640 - RNA, 19 nt, Artificial Sequence
  siRNA Sense Sequence
agcugugagggucaagcac

SEQ ID NO: 1641 - RNA, 19 nt, Artificial Sequence
  siRNA Antisense Sequence
gugcuugacccucacagcu

SEQ ID NO: 1642 - RNA, 19 nt, Artificial Sequence
  siRNA Sense Sequence
gugagggucaagcacagcu

SEQ ID NO: 1643 - RNA, 19 nt, Artificial Sequence
  siRNA Antisense Sequence
agcugugcuugacccucac

SEQ ID NO: 1644 - RNA, 19 nt, Artificial Sequence
  siRNA Sense Sequence
ugagggucaagcacagcua

SEQ ID NO: 1645 - RNA, 19 nt, Artificial Sequence
  siRNA Antisense Sequence
uagcugugcuugacccuca

SEQ ID NO: 1646 - RNA, 19 nt, Artificial Sequence
  siRNA Sense Sequence
gagggucaagcacagcuau

SEQ ID NO: 1647 - RNA, 19 nt, Artificial Sequence
  siRNA Antisense Sequence
auagcugugcuugacccuc

SEQ ID NO: 1648 - RNA, 19 nt, Artificial Sequence
  siRNA Sense Sequence
agggucaagcacagcuauc

SEQ ID NO: 1649 - RNA, 19 nt, Artificial Sequence
  siRNA Antisense Sequence
gauagcugugcuugacccu

SEQ ID NO: 1650 - RNA, 19 nt, Artificial Sequence
  siRNA Sense Sequence
gggucaagcacagcuaucc

SEQ ID NO: 1651 - RNA, 19 nt, Artificial Sequence
  siRNA Antisense Sequence
ggauagcugugcuugaccc

SEQ ID NO: 1652 - RNA, 19 nt, Artificial Sequence
  siRNA Sense Sequence
caagcacagcuauccauca

SEQ ID NO: 1653 - RNA, 19 nt, Artificial Sequence
  siRNA Antisense Sequence
ugauggauagcugugcuug

SEQ ID NO: 1654 - RNA, 19 nt, Artificial Sequence
  siRNA Sense Sequence
cacagcuauccaucagaug

SEQ ID NO: 1655 - RNA, 19 nt, Artificial Sequence
  siRNA Antisense Sequence
caucugauggauagcugug

SEQ ID NO: 1656 - RNA, 19 nt, Artificial Sequence
  siRNA Sense Sequence
acagcuauccaucagauga

SEQ ID NO: 1657 - RNA, 19 nt, Artificial Sequence
  siRNA Antisense Sequence
ucaucugauggauagcugu

SEQ ID NO: 1658 - RNA, 19 nt, Artificial Sequence
  siRNA Sense Sequence
cagcuauccaucagaugau

SEQ ID NO: 1659 - RNA, 19 nt, Artificial Sequence
  siRNA Antisense Sequence
aucaucugauggauagcug

SEQ ID NO: 1660 - RNA, 19 nt, Artificial Sequence
  siRNA Sense Sequence
agcuauccaucagaugauc

SEQ ID NO: 1661 - RNA, 19 nt, Artificial Sequence
  siRNA Antisense Sequence
gaucaucugauggauagcu

SEQ ID NO: 1662 - RNA, 19 nt, Artificial Sequence
  siRNA Sense Sequence
gcuauccaucagaugaucu

SEQ ID NO: 1663 - RNA, 19 nt, Artificial Sequence
  siRNA Antisense Sequence
agaucaucugauggauagc

SEQ ID NO: 1664 - RNA, 19 nt, Artificial Sequence
  siRNA Sense Sequence
cuauccaucagaugaucua

SEQ ID NO: 1665 - RNA, 19 nt, Artificial Sequence
  siRNA Antisense Sequence
uagaucaucugauggauag

SEQ ID NO: 1666 - RNA, 19 nt, Artificial Sequence
  siRNA Sense Sequence
caucagaugaucuacuuuc

SEQ ID NO: 1667 - RNA, 19 nt, Artificial Sequence
  siRNA Antisense Sequence
gaaaguagaucaucugaug

SEQ ID NO: 1668 - RNA, 19 nt, Artificial Sequence
  siRNA Sense Sequence
agaugaucuacuuucagcc

SEQ ID NO: 1669 - RNA, 19 nt, Artificial Sequence
  siRNA Antisense Sequence
ggcugaaaguagaucaucu

SEQ ID NO: 1670 - RNA, 19 nt, Artificial Sequence
  siRNA Sense Sequence
gaucuacuuucagccuucc

SEQ ID NO: 1671 - RNA, 19 nt, Artificial Sequence
  siRNA Antisense Sequence
ggaaggcugaaaguagauc

SEQ ID NO: 1672 - RNA, 19 nt, Artificial Sequence
  siRNA Sense Sequence
aucuacuuucagccuuccu

SEQ ID NO: 1673 - RNA, 19 nt, Artificial Sequence
  siRNA Antisense Sequence
aggaaggcugaaaguagau

SEQ ID NO: 1674 - RNA, 19 nt, Artificial Sequence
  siRNA Sense Sequence
caauagaagacagguggcu

SEQ ID NO: 1675 - RNA, 19 nt, Artificial Sequence
  siRNA Antisense Sequence
agccaccugucuucuauug

SEQ ID NO: 1676 - RNA, 19 nt, Artificial Sequence
  siRNA Sense Sequence
aauagaagacagguggcug

SEQ ID NO: 1677 - RNA, 19 nt, Artificial Sequence
  siRNA Antisense Sequence
cagccaccugucuucuauu

SEQ ID NO: 1678 - RNA, 19 nt, Artificial Sequence
  siRNA Sense Sequence
cagguggcuguacccuugg

SEQ ID NO: 1679 - RNA, 19 nt, Artificial Sequence
  siRNA Antisense Sequence
ccaaggguacagccaccug

SEQ ID NO: 1680 - RNA, 19 nt, Artificial Sequence
  siRNA Sense Sequence
agguggcuguacccuuggc

SEQ ID NO: 1681 - RNA, 19 nt, Artificial Sequence
  siRNA Antisense Sequence
gccaaggguacagccaccu

SEQ ID NO: 1682 - RNA, 19 nt, Artificial Sequence
  siRNA Sense Sequence
ggcuguacccuuggccaag

SEQ ID NO: 1683 - RNA, 19 nt, Artificial Sequence
  siRNA Antisense Sequence
cuuggccaaggguacagcc

SEQ ID NO: 1684 - RNA, 19 nt, Artificial Sequence
  siRNA Sense Sequence
uggugucugcugucacugu

SEQ ID NO: 1685 - RNA, 19 nt, Artificial Sequence
  siRNA Antisense Sequence
acagugacagcagacacca

SEQ ID NO: 1686 - RNA, 19 nt, Artificial Sequence
  siRNA Sense Sequence
gucugcugucacugugccc

SEQ ID NO: 1687 - RNA, 19 nt, Artificial Sequence
  siRNA Antisense Sequence
gggcacagugacagcagac

SEQ ID NO: 1688 - RNA, 19 nt, Artificial Sequence
  siRNA Sense Sequence
cugcugucacugugcccuc

SEQ ID NO: 1689 - RNA, 19 nt, Artificial Sequence
  siRNA Antisense Sequence
gagggcacagugacagcag

SEQ ID NO: 1690 - RNA, 19 nt, Artificial Sequence
  siRNA Sense Sequence
ugcugucacugugcccuca

SEQ ID NO: 1691 - RNA, 19 nt, Artificial Sequence
  siRNA Antisense Sequence
ugagggcacagugacagca

SEQ ID NO: 1692 - RNA, 19 nt, Artificial Sequence
  siRNA Sense Sequence
gcugucacugugcccucau

SEQ ID NO: 1693 - RNA, 19 nt, Artificial Sequence
  siRNA Antisense Sequence
augagggcacagugacagc

SEQ ID NO: 1694 - RNA, 19 nt, Artificial Sequence
  siRNA Sense Sequence
cugucacugugcccucauu

SEQ ID NO: 1695 - RNA, 19 nt, Artificial Sequence
  siRNA Antisense Sequence
aaugagggcacagugacag

SEQ ID NO: 1696 - RNA, 19 nt, Artificial Sequence
  siRNA Sense Sequence
ugucacugugcccucauug

SEQ ID NO: 1697 - RNA, 19 nt, Artificial Sequence
  siRNA Antisense Sequence
caaugagggcacagugaca

SEQ ID NO: 1698 - RNA, 19 nt, Artificial Sequence
  siRNA Sense Sequence
gucacugugcccucauugg

SEQ ID NO: 1699 - RNA, 19 nt, Artificial Sequence
  siRNA Antisense Sequence
ccaaugagggcacagugac

SEQ ID NO: 1700 - RNA, 19 nt, Artificial Sequence
  siRNA Sense Sequence
acugugcccucauuggccc

SEQ ID NO: 1701 - RNA, 19 nt, Artificial Sequence
  siRNA Antisense Sequence
gggccaaugagggcacagu

SEQ ID NO: 1702 - RNA, 19 nt, Artificial Sequence
  siRNA Sense Sequence
cccagcaaucagacucaac

SEQ ID NO: 1703 - RNA, 19 nt, Artificial Sequence
  siRNA Antisense Sequence
guugagucugauugcuggg

SEQ ID NO: 1704 - RNA, 19 nt, Artificial Sequence
  siRNA Sense Sequence
ggagcaacugccauccgag

SEQ ID NO: 1705 - RNA, 19 nt, Artificial Sequence
  siRNA Antisense Sequence
cucggauggcaguugcucc

SEQ ID NO: 1706 - RNA, 19 nt, Artificial Sequence
  siRNA Sense Sequence
gagcaacugccauccgagg

SEQ ID NO: 1707 - RNA, 19 nt, Artificial Sequence
  siRNA Antisense Sequence
ccucggauggcaguugcuc

SEQ ID NO: 1708 - RNA, 19 nt, Artificial Sequence
  siRNA Sense Sequence
agcaacugccauccgaggc

SEQ ID NO: 1709 - RNA, 19 nt, Artificial Sequence
  siRNA Antisense Sequence
gccucggauggcaguugcu

SEQ ID NO: 1710 - RNA, 19 nt, Artificial Sequence
  siRNA Sense Sequence
gcaacugccauccgaggcu

SEQ ID NO: 1711 - RNA, 19 nt, Artificial Sequence
  siRNA Antisense Sequence
agccucggauggcaguugc

SEQ ID NO: 1712 - RNA, 19 nt, Artificial Sequence
  siRNA Sense Sequence
caacugccauccgaggcuc

SEQ ID NO: 1713 - RNA, 19 nt, Artificial Sequence
  siRNA Antisense Sequence
gagccucggauggcaguug

SEQ ID NO: 1714 - RNA, 19 nt, Artificial Sequence
  siRNA Sense Sequence
gccauccgaggcuccugaa

SEQ ID NO: 1715 - RNA, 19 nt, Artificial Sequence
  siRNA Antisense Sequence
uucaggagccucggauggc

SEQ ID NO: 1716 - RNA, 19 nt, Artificial Sequence
  siRNA Sense Sequence
aaccagggccauucaccag

SEQ ID NO: 1717 - RNA, 19 nt, Artificial Sequence
  siRNA Antisense Sequence
cuggugaauggcccugguu

SEQ ID NO: 1718 - RNA, 19 nt, Artificial Sequence
  siRNA Sense Sequence
accagggccauucaccagg

SEQ ID NO: 1719 - RNA, 19 nt, Artificial Sequence
  siRNA Antisense Sequence
ccuggugaauggcccuggu

SEQ ID NO: 1720 - RNA, 19 nt, Artificial Sequence
  siRNA Sense Sequence
ccagggccauucaccagga

SEQ ID NO: 1721 - RNA, 19 nt, Artificial Sequence
  siRNA Antisense Sequence
uccuggugaauggcccugg

SEQ ID NO: 1722 - RNA, 19 nt, Artificial Sequence
  siRNA Sense Sequence
cagggccauucaccaggag

SEQ ID NO: 1723 - RNA, 19 nt, Artificial Sequence
  siRNA Antisense Sequence
cuccuggugaauggcccug

SEQ ID NO: 1724 - RNA, 19 nt, Artificial Sequence
  siRNA Sense Sequence
ggccauucaccaggagcau

SEQ ID NO: 1725 - RNA, 19 nt, Artificial Sequence
  siRNA Antisense Sequence
augcuccuggugaauggcc

SEQ ID NO: 1726 - RNA, 19 nt, Artificial Sequence
  siRNA Sense Sequence
gccauucaccaggagcaug

SEQ ID NO: 1727 - RNA, 19 nt, Artificial Sequence
  siRNA Antisense Sequence
caugcuccuggugaauggc

SEQ ID NO: 1728 - RNA, 19 nt, Artificial Sequence
  siRNA Sense Sequence
ccauucaccaggagcaugc

SEQ ID NO: 1729 - RNA, 19 nt, Artificial Sequence
  siRNA Antisense Sequence
gcaugcuccuggugaaugg

SEQ ID NO: 1730 - RNA, 19 nt, Artificial Sequence
  siRNA Sense Sequence
cauucaccaggagcaugcg

SEQ ID NO: 1731 - RNA, 19 nt, Artificial Sequence
  siRNA Antisense Sequence
cgcaugcuccuggugaaug

SEQ ID NO: 1732 - RNA, 19 nt, Artificial Sequence
  siRNA Sense Sequence
auucaccaggagcaugcgg

SEQ ID NO: 1733 - RNA, 19 nt, Artificial Sequence
  siRNA Antisense Sequence
ccgcaugcuccuggugaau

SEQ ID NO: 1734 - RNA, 19 nt, Artificial Sequence
  siRNA Sense Sequence
uucaccaggagcaugcggc

SEQ ID NO: 1735 - RNA, 19 nt, Artificial Sequence
  siRNA Antisense Sequence
gccgcaugcuccuggugaa

SEQ ID NO: 1736 - RNA, 19 nt, Artificial Sequence
  siRNA Sense Sequence
ucaccaggagcaugcggcu

SEQ ID NO: 1737 - RNA, 19 nt, Artificial Sequence
  siRNA Antisense Sequence
agccgcaugcuccugguga

SEQ ID NO: 1738 - RNA, 19 nt, Artificial Sequence
  siRNA Sense Sequence
agcaugcggcucccugaug

SEQ ID NO: 1739 - RNA, 19 nt, Artificial Sequence
  siRNA Antisense Sequence
caucagggagccgcaugcu

SEQ ID NO: 1740 - RNA, 19 nt, Artificial Sequence
  siRNA Sense Sequence
gcaugcggcucccugaugu

SEQ ID NO: 1741 - RNA, 19 nt, Artificial Sequence
  siRNA Antisense Sequence
acaucagggagccgcaugc

SEQ ID NO: 1742 - RNA, 19 nt, Artificial Sequence
  siRNA Sense Sequence
caugcggcucccugauguc

SEQ ID NO: 1743 - RNA, 19 nt, Artificial Sequence
  siRNA Antisense Sequence
gacaucagggagccgcaug

SEQ ID NO: 1744 - RNA, 19 nt, Artificial Sequence
  siRNA Sense Sequence
augcggcucccugaugucc

SEQ ID NO: 1745 - RNA, 19 nt, Artificial Sequence
  siRNA Antisense Sequence
ggacaucagggagccgcau

SEQ ID NO: 1746 - RNA, 19 nt, Artificial Sequence
  siRNA Sense Sequence
ugcggcucccugaugucca

SEQ ID NO: 1747 - RNA, 19 nt, Artificial Sequence
  siRNA Antisense Sequence
uggacaucagggagccgca

SEQ ID NO: 1748 - RNA, 19 nt, Artificial Sequence
  siRNA Sense Sequence
gcucccugauguccagcuc

SEQ ID NO: 1749 - RNA, 19 nt, Artificial Sequence
  siRNA Antisense Sequence
gagcuggacaucagggagc

SEQ ID NO: 1750 - RNA, 19 nt, Artificial Sequence
  siRNA Sense Sequence
cucccugauguccagcucu

SEQ ID NO: 1751 - RNA, 19 nt, Artificial Sequence
  siRNA Antisense Sequence
agagcuggacaucagggag

SEQ ID NO: 1752 - RNA, 19 nt, Artificial Sequence
  siRNA Sense Sequence
ucccugauguccagcucug

SEQ ID NO: 1753 - RNA, 19 nt, Artificial Sequence
  siRNA Antisense Sequence
cagagcuggacaucaggga

SEQ ID NO: 1754 - RNA, 19 nt, Artificial Sequence
  siRNA Sense Sequence
cccugauguccagcucugg

SEQ ID NO: 1755 - RNA, 19 nt, Artificial Sequence
  siRNA Antisense Sequence
ccagagcuggacaucaggg

SEQ ID NO: 1756 - RNA, 19 nt, Artificial Sequence
  siRNA Sense Sequence
ccugauguccagcucuggc

SEQ ID NO: 1757 - RNA, 19 nt, Artificial Sequence
  siRNA Antisense Sequence
gccagagcuggacaucagg

SEQ ID NO: 1758 - RNA, 19 nt, Artificial Sequence
  siRNA Sense Sequence
cugauguccagcucuggcu

SEQ ID NO: 1759 - RNA, 19 nt, Artificial Sequence
  siRNA Antisense Sequence
agccagagcuggacaucag

SEQ ID NO: 1760 - RNA, 19 nt, Artificial Sequence
  siRNA Sense Sequence
ucuggugcuggagcuagcc

SEQ ID NO: 1761 - RNA, 19 nt, Artificial Sequence
  siRNA Antisense Sequence
ggcuagcuccagcaccaga

SEQ ID NO: 1762 - RNA, 19 nt, Artificial Sequence
  siRNA Sense Sequence
uggugcuggagcuagccaa

SEQ ID NO: 1763 - RNA, 19 nt, Artificial Sequence
  siRNA Antisense Sequence
uuggcuagcuccagcacca

SEQ ID NO: 1764 - RNA, 19 nt, Artificial Sequence
  siRNA Sense Sequence
ggugcuggagcuagccaag

SEQ ID NO: 1765 - RNA, 19 nt, Artificial Sequence
  siRNA Antisense Sequence
cuuggcuagcuccagcacc

SEQ ID NO: 1766 - RNA, 19 nt, Artificial Sequence
  siRNA Sense Sequence
gugcuggagcuagccaagc

SEQ ID NO: 1767 - RNA, 19 nt, Artificial Sequence
  siRNA Antisense Sequence
gcuuggcuagcuccagcac

SEQ ID NO: 1768 - RNA, 19 nt, Artificial Sequence
  siRNA Sense Sequence
gcuggagcuagccaagcag

SEQ ID NO: 1769 - RNA, 19 nt, Artificial Sequence
  siRNA Antisense Sequence
cugcuuggcuagcuccagc

SEQ ID NO: 1770 - RNA, 19 nt, Artificial Sequence
  siRNA Sense Sequence
cuggagcuagccaagcagc

SEQ ID NO: 1771 - RNA, 19 nt, Artificial Sequence
  siRNA Antisense Sequence
gcugcuuggcuagcuccag

SEQ ID NO: 1772 - RNA, 19 nt, Artificial Sequence
  siRNA Sense Sequence
uggagcuagccaagcagca

SEQ ID NO: 1773 - RNA, 19 nt, Artificial Sequence
  siRNA Antisense Sequence
ugcugcuuggcuagcucca

SEQ ID NO: 1774 - RNA, 19 nt, Artificial Sequence
  siRNA Sense Sequence
ggagcuagccaagcagcaa

SEQ ID NO: 1775 - RNA, 19 nt, Artificial Sequence
  siRNA Antisense Sequence
uugcugcuuggcuagcucc

SEQ ID NO: 1776 - RNA, 19 nt, Artificial Sequence
  siRNA Sense Sequence
gagcuagccaagcagcaaa

SEQ ID NO: 1777 - RNA, 19 nt, Artificial Sequence
  siRNA Antisense Sequence
uuugcugcuuggcuagcuc

SEQ ID NO: 1778 - RNA, 19 nt, Artificial Sequence
  siRNA Sense Sequence
agcuagccaagcagcaaau

SEQ ID NO: 1779 - RNA, 19 nt, Artificial Sequence
  siRNA Antisense Sequence
auuugcugcuuggcuagcu

SEQ ID NO: 1780 - RNA, 19 nt, Artificial Sequence
  siRNA Sense Sequence
gcuagccaagcagcaaauc

SEQ ID NO: 1781 - RNA, 19 nt, Artificial Sequence
  siRNA Antisense Sequence
gauuugcugcuuggcuagc

SEQ ID NO: 1782 - RNA, 19 nt, Artificial Sequence
  siRNA Sense Sequence
cagcaaauccuggaugggu

SEQ ID NO: 1783 - RNA, 19 nt, Artificial Sequence
  siRNA Antisense Sequence
acccauccaggauuugcug

SEQ ID NO: 1784 - RNA, 19 nt, Artificial Sequence
  siRNA Sense Sequence
agcaaauccuggauggguu

SEQ ID NO: 1785 - RNA, 19 nt, Artificial Sequence
  siRNA Antisense Sequence
aacccauccaggauuugcu

SEQ ID NO: 1786 - RNA, 19 nt, Artificial Sequence
  siRNA Sense Sequence
gcaaauccuggauggguug

SEQ ID NO: 1787 - RNA, 19 nt, Artificial Sequence
  siRNA Antisense Sequence
caacccauccaggauuugc

SEQ ID NO: 1788 - RNA, 19 nt, Artificial Sequence
  siRNA Sense Sequence
caaauccuggauggguugc

SEQ ID NO: 1789 - RNA, 19 nt, Artificial Sequence
  siRNA Antisense Sequence
gcaacccauccaggauuug

SEQ ID NO: 1790 - RNA, 19 nt, Artificial Sequence
  siRNA Sense Sequence
aaauccuggauggguugca

SEQ ID NO: 1791 - RNA, 19 nt, Artificial Sequence
  siRNA Antisense Sequence
ugcaacccauccaggauuu

SEQ ID NO: 1792 - RNA, 19 nt, Artificial Sequence
  siRNA Sense Sequence
gguugcaccugaccagucg

SEQ ID NO: 1793 - RNA, 19 nt, Artificial Sequence
  siRNA Antisense Sequence
cgacuggucaggugcaacc

SEQ ID NO: 1794 - RNA, 19 nt, Artificial Sequence
  siRNA Sense Sequence
guugcaccugaccagucgu

SEQ ID NO: 1795 - RNA, 19 nt, Artificial Sequence
  siRNA Antisense Sequence
acgacuggucaggugcaac

SEQ ID NO: 1796 - RNA, 19 nt, Artificial Sequence
  siRNA Sense Sequence
uugcaccugaccagucguc

SEQ ID NO: 1797 - RNA, 19 nt, Artificial Sequence
  siRNA Antisense Sequence
gacgacuggucaggugcaa

SEQ ID NO: 1798 - RNA, 19 nt, Artificial Sequence
  siRNA Sense Sequence
ugcaccugaccagucgucc

SEQ ID NO: 1799 - RNA, 19 nt, Artificial Sequence
  siRNA Antisense Sequence
ggacgacuggucaggugca

SEQ ID NO: 1800 - RNA, 19 nt, Artificial Sequence
  siRNA Sense Sequence
ugaccagucgucccagaau

SEQ ID NO: 1801 - RNA, 19 nt, Artificial Sequence
  siRNA Antisense Sequence
auucugggacgacugguca

SEQ ID NO: 1802 - RNA, 19 nt, Artificial Sequence
  siRNA Sense Sequence
gaccagucgucccagaaua

SEQ ID NO: 1803 - RNA, 19 nt, Artificial Sequence
  siRNA Antisense Sequence
uauucugggacgacugguc

SEQ ID NO: 1804 - RNA, 19 nt, Artificial Sequence
  siRNA Sense Sequence
accagucgucccagaauaa

SEQ ID NO: 1805 - RNA, 19 nt, Artificial Sequence
  siRNA Antisense Sequence
uuauucugggacgacuggu

SEQ ID NO: 1806 - RNA, 19 nt, Artificial Sequence
  siRNA Sense Sequence
ccagucgucccagaauaac

SEQ ID NO: 1807 - RNA, 19 nt, Artificial Sequence
  siRNA Antisense Sequence
guuauucugggacgacugg

SEQ ID NO: 1808 - RNA, 19 nt, Artificial Sequence
  siRNA Sense Sequence
cagucgucccagaauaacu

SEQ ID NO: 1809 - RNA, 19 nt, Artificial Sequence
  siRNA Antisense Sequence
aguuauucugggacgacug

SEQ ID NO: 1810 - RNA, 19 nt, Artificial Sequence
  siRNA Sense Sequence
agucgucccagaauaacuc

SEQ ID NO: 1811 - RNA, 19 nt, Artificial Sequence
  siRNA Antisense Sequence
gaguuauucugggacgacu

SEQ ID NO: 1812 - RNA, 19 nt, Artificial Sequence
  siRNA Sense Sequence
gucgucccagaauaacuca

SEQ ID NO: 1813 - RNA, 19 nt, Artificial Sequence
  siRNA Antisense Sequence
ugaguuauucugggacgac

SEQ ID NO: 1814 - RNA, 19 nt, Artificial Sequence
  siRNA Sense Sequence
ucgucccagaauaacucau

SEQ ID NO: 1815 - RNA, 19 nt, Artificial Sequence
  siRNA Antisense Sequence
augaguuauucugggacga

SEQ ID NO: 1816 - RNA, 19 nt, Artificial Sequence
  siRNA Sense Sequence
cgucccagaauaacucauc

SEQ ID NO: 1817 - RNA, 19 nt, Artificial Sequence
  siRNA Antisense Sequence
gaugaguuauucugggacg

SEQ ID NO: 1818 - RNA, 19 nt, Artificial Sequence
  siRNA Sense Sequence
gucccagaauaacucaucc

SEQ ID NO: 1819 - RNA, 19 nt, Artificial Sequence
  siRNA Antisense Sequence
ggaugaguuauucugggac

SEQ ID NO: 1820 - RNA, 19 nt, Artificial Sequence
  siRNA Sense Sequence
ucccagaauaacucauccu

SEQ ID NO: 1821 - RNA, 19 nt, Artificial Sequence
  siRNA Antisense Sequence
aggaugaguuauucuggga

SEQ ID NO: 1822 - RNA, 19 nt, Artificial Sequence
  siRNA Sense Sequence
cccagaauaacucauccuc

SEQ ID NO: 1823 - RNA, 19 nt, Artificial Sequence
  siRNA Antisense Sequence
gaggaugaguuauucuggg

SEQ ID NO: 1824 - RNA, 19 nt, Artificial Sequence
  siRNA Sense Sequence
gacuacagccagggagugu

SEQ ID NO: 1825 - RNA, 19 nt, Artificial Sequence
  siRNA Antisense Sequence
acacucccuggcuguaguc

SEQ ID NO: 1826 - RNA, 19 nt, Artificial Sequence
  siRNA Sense Sequence
acuacagccagggagugug

SEQ ID NO: 1827 - RNA, 19 nt, Artificial Sequence
  siRNA Antisense Sequence
cacacucccuggcuguagu

SEQ ID NO: 1828 - RNA, 19 nt, Artificial Sequence
  siRNA Sense Sequence
cuacagccagggagugugg

SEQ ID NO: 1829 - RNA, 19 nt, Artificial Sequence
  siRNA Antisense Sequence
ccacacucccuggcuguag

SEQ ID NO: 1830 - RNA, 19 nt, Artificial Sequence
  siRNA Sense Sequence
gaguguggcuccagggaau

SEQ ID NO: 1831 - RNA, 19 nt, Artificial Sequence
  siRNA Antisense Sequence
auucccuggagccacacuc

SEQ ID NO: 1832 - RNA, 19 nt, Artificial Sequence
  siRNA Sense Sequence
gggaggaggucaucagcuu

SEQ ID NO: 1833 - RNA, 19 nt, Artificial Sequence
  siRNA Antisense Sequence
aagcugaugaccuccuccc

SEQ ID NO: 1834 - RNA, 19 nt, Artificial Sequence
  siRNA Sense Sequence
gaggucaucagcuuugcua

SEQ ID NO: 1835 - RNA, 19 nt, Artificial Sequence
  siRNA Antisense Sequence
uagcaaagcugaugaccuc

SEQ ID NO: 1836 - RNA, 19 nt, Artificial Sequence
  siRNA Sense Sequence
aggucaucagcuuugcuac

SEQ ID NO: 1837 - RNA, 19 nt, Artificial Sequence
  siRNA Antisense Sequence
guagcaaagcugaugaccu

SEQ ID NO: 1838 - RNA, 19 nt, Artificial Sequence
  siRNA Sense Sequence
ggucaucagcuuugcuacu

SEQ ID NO: 1839 - RNA, 19 nt, Artificial Sequence
  siRNA Antisense Sequence
aguagcaaagcugaugacc

SEQ ID NO: 1840 - RNA, 19 nt, Artificial Sequence
  siRNA Sense Sequence
gcuuugcuacugucacaga

SEQ ID NO: 1841 - RNA, 19 nt, Artificial Sequence
  siRNA Antisense Sequence
ucugugacaguagcaaagc

SEQ ID NO: 1842 - RNA, 19 nt, Artificial Sequence
  siRNA Sense Sequence
cuuugcuacugucacagac

SEQ ID NO: 1843 - RNA, 19 nt, Artificial Sequence
  siRNA Antisense Sequence
gucugugacaguagcaaag

SEQ ID NO: 1844 - RNA, 19 nt, Artificial Sequence
  siRNA Sense Sequence
uuugcuacugucacagacu

SEQ ID NO: 1845 - RNA, 19 nt, Artificial Sequence
  siRNA Antisense Sequence
agucugugacaguagcaaa

SEQ ID NO: 1846 - RNA, 19 nt, Artificial Sequence
  siRNA Sense Sequence
uugcuacugucacagacuc

SEQ ID NO: 1847 - RNA, 19 nt, Artificial Sequence
  siRNA Antisense Sequence
gagucugugacaguagcaa

SEQ ID NO: 1848 - RNA, 19 nt, Artificial Sequence
  siRNA Sense Sequence
ugcuacugucacagacucc

SEQ ID NO: 1849 - RNA, 19 nt, Artificial Sequence
  siRNA Antisense Sequence
ggagucugugacaguagca

SEQ ID NO: 1850 - RNA, 19 nt, Artificial Sequence
  siRNA Sense Sequence
acugucacagacuccacuu

SEQ ID NO: 1851 - RNA, 19 nt, Artificial Sequence
  siRNA Antisense Sequence
aaguggagucugugacagu

SEQ ID NO: 1852 - RNA, 19 nt, Artificial Sequence
  siRNA Sense Sequence
cugucacagacuccacuuc

SEQ ID NO: 1853 - RNA, 19 nt, Artificial Sequence
  siRNA Antisense Sequence
gaaguggagucugugacag

SEQ ID NO: 1854 - RNA, 19 nt, Artificial Sequence
  siRNA Sense Sequence
ugucacagacuccacuuca

SEQ ID NO: 1855 - RNA, 19 nt, Artificial Sequence
  siRNA Antisense Sequence
ugaaguggagucugugaca

SEQ ID NO: 1856 - RNA, 19 nt, Artificial Sequence
  siRNA Sense Sequence
gucacagacuccacuucag

SEQ ID NO: 1857 - RNA, 19 nt, Artificial Sequence
  siRNA Antisense Sequence
cugaaguggagucugugac

SEQ ID NO: 1858 - RNA, 19 nt, Artificial Sequence
  siRNA Sense Sequence
ucacagacuccacuucagc

SEQ ID NO: 1859 - RNA, 19 nt, Artificial Sequence
  siRNA Antisense Sequence
gcugaaguggagucuguga

SEQ ID NO: 1860 - RNA, 19 nt, Artificial Sequence
  siRNA Sense Sequence
cacagacuccacuucagcc

SEQ ID NO: 1861 - RNA, 19 nt, Artificial Sequence
  siRNA Antisense Sequence
ggcugaaguggagucugug

SEQ ID NO: 1862 - RNA, 19 nt, Artificial Sequence
  siRNA Sense Sequence
uccacuucagccuacagcu

SEQ ID NO: 1863 - RNA, 19 nt, Artificial Sequence
  siRNA Antisense Sequence
agcuguaggcugaagugga

SEQ ID NO: 1864 - RNA, 19 nt, Artificial Sequence
  siRNA Sense Sequence
ccacuucagccuacagcuc

SEQ ID NO: 1865 - RNA, 19 nt, Artificial Sequence
  siRNA Antisense Sequence
gagcuguaggcugaagugg

SEQ ID NO: 1866 - RNA, 19 nt, Artificial Sequence
  siRNA Sense Sequence
cacuucagccuacagcucc

SEQ ID NO: 1867 - RNA, 19 nt, Artificial Sequence
  siRNA Antisense Sequence
ggagcuguaggcugaagug

SEQ ID NO: 1868 - RNA, 19 nt, Artificial Sequence
  siRNA Sense Sequence
acuucagccuacagcuccc

SEQ ID NO: 1869 - RNA, 19 nt, Artificial Sequence
  siRNA Antisense Sequence
gggagcuguaggcugaagu

SEQ ID NO: 1870 - RNA, 19 nt, Artificial Sequence
  siRNA Sense Sequence
ccuacagcucccugcucac

SEQ ID NO: 1871 - RNA, 19 nt, Artificial Sequence
  siRNA Antisense Sequence
gugagcagggagcuguagg

SEQ ID NO: 1872 - RNA, 19 nt, Artificial Sequence
  siRNA Sense Sequence
cuacagcucccugcucacu

SEQ ID NO: 1873 - RNA, 19 nt, Artificial Sequence
  siRNA Antisense Sequence
agugagcagggagcuguag

SEQ ID NO: 1874 - RNA, 19 nt, Artificial Sequence
  siRNA Sense Sequence
uacagcucccugcucacuu

SEQ ID NO: 1875 - RNA, 19 nt, Artificial Sequence
  siRNA Antisense Sequence
aagugagcagggagcugua

SEQ ID NO: 1876 - RNA, 19 nt, Artificial Sequence
  siRNA Sense Sequence
gcucccugcucacuuuuca

SEQ ID NO: 1877 - RNA, 19 nt, Artificial Sequence
  siRNA Antisense Sequence
ugaaaagugagcagggagc

SEQ ID NO: 1878 - RNA, 19 nt, Artificial Sequence
  siRNA Sense Sequence
cucccugcucacuuuucac

SEQ ID NO: 1879 - RNA, 19 nt, Artificial Sequence
  siRNA Antisense Sequence
gugaaaagugagcagggag

SEQ ID NO: 1880 - RNA, 19 nt, Artificial Sequence
  siRNA Sense Sequence
gcucacuuuucaccugucc

SEQ ID NO: 1881 - RNA, 19 nt, Artificial Sequence
  siRNA Antisense Sequence
ggacaggugaaaagugagc

SEQ ID NO: 1882 - RNA, 19 nt, Artificial Sequence
  siRNA Sense Sequence
cucacuuuucaccugucca

SEQ ID NO: 1883 - RNA, 19 nt, Artificial Sequence
  siRNA Antisense Sequence
uggacaggugaaaagugag

SEQ ID NO: 1884 - RNA, 19 nt, Artificial Sequence
  siRNA Sense Sequence
uguccacuccucgguccca

SEQ ID NO: 1885 - RNA, 19 nt, Artificial Sequence
  siRNA Antisense Sequence
ugggaccgaggaguggaca

SEQ ID NO: 1886 - RNA, 19 nt, Artificial Sequence
  siRNA Sense Sequence
ucggucccaccaccuguac

SEQ ID NO: 1887 - RNA, 19 nt, Artificial Sequence
  siRNA Antisense Sequence
guacagguggugggaccga

SEQ ID NO: 1888 - RNA, 19 nt, Artificial Sequence
  siRNA Sense Sequence
ccaccaccuguaccaugcc

SEQ ID NO: 1889 - RNA, 19 nt, Artificial Sequence
  siRNA Antisense Sequence
ggcaugguacagguggugg

SEQ ID NO: 1890 - RNA, 19 nt, Artificial Sequence
  siRNA Sense Sequence
caccaccuguaccaugccc

SEQ ID NO: 1891 - RNA, 19 nt, Artificial Sequence
  siRNA Antisense Sequence
gggcaugguacagguggug

SEQ ID NO: 1892 - RNA, 19 nt, Artificial Sequence
  siRNA Sense Sequence
accaccuguaccaugcccg

SEQ ID NO: 1893 - RNA, 19 nt, Artificial Sequence
  siRNA Antisense Sequence
cgggcaugguacagguggu

SEQ ID NO: 1894 - RNA, 19 nt, Artificial Sequence
  siRNA Sense Sequence
cacccuuccuggcacucuu

SEQ ID NO: 1895 - RNA, 19 nt, Artificial Sequence
  siRNA Antisense Sequence
aagagugccaggaagggug

SEQ ID NO: 1896 - RNA, 19 nt, Artificial Sequence
  siRNA Sense Sequence
acccuuccuggcacucuuu

SEQ ID NO: 1897 - RNA, 19 nt, Artificial Sequence
  siRNA Antisense Sequence
aaagagugccaggaagggu

SEQ ID NO: 1898 - RNA, 19 nt, Artificial Sequence
  siRNA Sense Sequence
cccuuccuggcacucuuug

SEQ ID NO: 1899 - RNA, 19 nt, Artificial Sequence
  siRNA Antisense Sequence
caaagagugccaggaaggg

SEQ ID NO: 1900 - RNA, 19 nt, Artificial Sequence
  siRNA Sense Sequence
ccuuccuggcacucuuugc

SEQ ID NO: 1901 - RNA, 19 nt, Artificial Sequence
  siRNA Antisense Sequence
gcaaagagugccaggaagg

SEQ ID NO: 1902 - RNA, 19 nt, Artificial Sequence
  siRNA Sense Sequence
uuccuggcacucuuugcuu

SEQ ID NO: 1903 - RNA, 19 nt, Artificial Sequence
  siRNA Antisense Sequence
aagcaaagagugccaggaa

SEQ ID NO: 1904 - RNA, 19 nt, Artificial Sequence
  siRNA Sense Sequence
uccuggcacucuuugcuug

SEQ ID NO: 1905 - RNA, 19 nt, Artificial Sequence
  siRNA Antisense Sequence
caagcaaagagugccagga

SEQ ID NO: 1906 - RNA, 19 nt, Artificial Sequence
  siRNA Sense Sequence
ccuggcacucuuugcuuga

SEQ ID NO: 1907 - RNA, 19 nt, Artificial Sequence
  siRNA Antisense Sequence
ucaagcaaagagugccagg

SEQ ID NO: 1908 - RNA, 19 nt, Artificial Sequence
  siRNA Sense Sequence
cuggcacucuuugcuugag

SEQ ID NO: 1909 - RNA, 19 nt, Artificial Sequence
  siRNA Antisense Sequence
cucaagcaaagagugccag

SEQ ID NO: 1910 - RNA, 19 nt, Artificial Sequence
  siRNA Sense Sequence
uggcacucuuugcuugagg

SEQ ID NO: 1911 - RNA, 19 nt, Artificial Sequence
  siRNA Antisense Sequence
ccucaagcaaagagugcca

SEQ ID NO: 1912 - RNA, 19 nt, Artificial Sequence
  siRNA Sense Sequence
ggcacucuuugcuugagga

SEQ ID NO: 1913 - RNA, 19 nt, Artificial Sequence
  siRNA Antisense Sequence
uccucaagcaaagagugcc

SEQ ID NO: 1914 - RNA, 19 nt, Artificial Sequence
  siRNA Sense Sequence
gcacucuuugcuugaggau

SEQ ID NO: 1915 - RNA, 19 nt, Artificial Sequence
  siRNA Antisense Sequence
auccucaagcaaagagugc

SEQ ID NO: 1916 - RNA, 19 nt, Artificial Sequence
  siRNA Sense Sequence
cacucuuugcuugaggauc

SEQ ID NO: 1917 - RNA, 19 nt, Artificial Sequence
  siRNA Antisense Sequence
gauccucaagcaaagagug

SEQ ID NO: 1918 - RNA, 19 nt, Artificial Sequence
  siRNA Sense Sequence
acucuuugcuugaggaucu

SEQ ID NO: 1919 - RNA, 19 nt, Artificial Sequence
  siRNA Antisense Sequence
agauccucaagcaaagagu

SEQ ID NO: 1920 - RNA, 19 nt, Artificial Sequence
  siRNA Sense Sequence
cucuuugcuugaggaucuu

SEQ ID NO: 1921 - RNA, 19 nt, Artificial Sequence
  siRNA Antisense Sequence
aagauccucaagcaaagag

SEQ ID NO: 1922 - RNA, 19 nt, Artificial Sequence
  siRNA Sense Sequence
ucuuugcuugaggaucuuc

SEQ ID NO: 1923 - RNA, 19 nt, Artificial Sequence
  siRNA Antisense Sequence
gaagauccucaagcaaaga

SEQ ID NO: 1924 - RNA, 19 nt, Artificial Sequence
  siRNA Sense Sequence
ugcuugaggaucuuccgau

SEQ ID NO: 1925 - RNA, 19 nt, Artificial Sequence
  siRNA Antisense Sequence
aucggaagauccucaagca

SEQ ID NO: 1926 - RNA, 19 nt, Artificial Sequence
  siRNA Sense Sequence
gcuugaggaucuuccgaug

SEQ ID NO: 1927 - RNA, 19 nt, Artificial Sequence
  siRNA Antisense Sequence
caucggaagauccucaagc

SEQ ID NO: 1928 - RNA, 19 nt, Artificial Sequence
  siRNA Sense Sequence
gcacucuccuggcugagca

SEQ ID NO: 1929 - RNA, 19 nt, Artificial Sequence
  siRNA Antisense Sequence
ugcucagccaggagagugc

SEQ ID NO: 1930 - RNA, 19 nt, Artificial Sequence
  siRNA Sense Sequence
cuccuggcugagcaccaca

SEQ ID NO: 1931 - RNA, 19 nt, Artificial Sequence
  siRNA Antisense Sequence
uguggugcucagccaggag

SEQ ID NO: 1932 - RNA, 19 nt, Artificial Sequence
  siRNA Sense Sequence
uggcugagcaccacaucac

SEQ ID NO: 1933 - RNA, 19 nt, Artificial Sequence
  siRNA Antisense Sequence
gugauguggugcucagcca

SEQ ID NO: 1934 - RNA, 19 nt, Artificial Sequence
  siRNA Sense Sequence
ggcugagcaccacaucacc

SEQ ID NO: 1935 - RNA, 19 nt, Artificial Sequence
  siRNA Antisense Sequence
ggugauguggugcucagcc

SEQ ID NO: 1936 - RNA, 19 nt, Artificial Sequence
  siRNA Sense Sequence
gcugagcaccacaucacca

SEQ ID NO: 1937 - RNA, 19 nt, Artificial Sequence
  siRNA Antisense Sequence
uggugauguggugcucagc

SEQ ID NO: 1938 - RNA, 19 nt, Artificial Sequence
  siRNA Sense Sequence
cugagcaccacaucaccaa

SEQ ID NO: 1939 - RNA, 19 nt, Artificial Sequence
  siRNA Antisense Sequence
uuggugauguggugcucag

SEQ ID NO: 1940 - RNA, 19 nt, Artificial Sequence
  siRNA Sense Sequence
ccaaccugggcuggcauac

SEQ ID NO: 1941 - RNA, 19 nt, Artificial Sequence
  siRNA Antisense Sequence
guaugccagcccagguugg

SEQ ID NO: 1942 - RNA, 19 nt, Artificial Sequence
  siRNA Sense Sequence
caaccugggcuggcauacc

SEQ ID NO: 1943 - RNA, 19 nt, Artificial Sequence
  siRNA Antisense Sequence
gguaugccagcccagguug

SEQ ID NO: 1944 - RNA, 19 nt, Artificial Sequence
  siRNA Sense Sequence
aaccugggcuggcauaccu

SEQ ID NO: 1945 - RNA, 19 nt, Artificial Sequence
  siRNA Antisense Sequence
agguaugccagcccagguu

SEQ ID NO: 1946 - RNA, 19 nt, Artificial Sequence
  siRNA Sense Sequence
accugggcuggcauaccuu

SEQ ID NO: 1947 - RNA, 19 nt, Artificial Sequence
  siRNA Antisense Sequence
aagguaugccagcccaggu

SEQ ID NO: 1948 - RNA, 19 nt, Artificial Sequence
  siRNA Sense Sequence
ccugggcuggcauaccuua

SEQ ID NO: 1949 - RNA, 19 nt, Artificial Sequence
  siRNA Antisense Sequence
uaagguaugccagcccagg

SEQ ID NO: 1950 - RNA, 19 nt, Artificial Sequence
  siRNA Sense Sequence
cugggcuggcauaccuuaa

SEQ ID NO: 1951 - RNA, 19 nt, Artificial Sequence
  siRNA Antisense Sequence
uuaagguaugccagcccag

SEQ ID NO: 1952 - RNA, 19 nt, Artificial Sequence
  siRNA Sense Sequence
ugggcuggcauaccuuaac

SEQ ID NO: 1953 - RNA, 19 nt, Artificial Sequence
  siRNA Antisense Sequence
guuaagguaugccagccca

SEQ ID NO: 1954 - RNA, 19 nt, Artificial Sequence
  siRNA Sense Sequence
gggcuggcauaccuuaacu

SEQ ID NO: 1955 - RNA, 19 nt, Artificial Sequence
  siRNA Antisense Sequence
aguuaagguaugccagccc

SEQ ID NO: 1956 - RNA, 19 nt, Artificial Sequence
  siRNA Sense Sequence
ggcuggcauaccuuaacuc

SEQ ID NO: 1957 - RNA, 19 nt, Artificial Sequence
  siRNA Antisense Sequence
gaguuaagguaugccagcc

SEQ ID NO: 1958 - RNA, 19 nt, Artificial Sequence
  siRNA Sense Sequence
gcuggcauaccuuaacucu

SEQ ID NO: 1959 - RNA, 19 nt, Artificial Sequence
  siRNA Antisense Sequence
agaguuaagguaugccagc

SEQ ID NO: 1960 - RNA, 19 nt, Artificial Sequence
  siRNA Sense Sequence
cauaccuuaacucugcccu

SEQ ID NO: 1961 - RNA, 19 nt, Artificial Sequence
  siRNA Antisense Sequence
agggcagaguuaagguaug

SEQ ID NO: 1962 - RNA, 19 nt, Artificial Sequence
  siRNA Sense Sequence
auaccuuaacucugcccuc

SEQ ID NO: 1963 - RNA, 19 nt, Artificial Sequence
  siRNA Antisense Sequence
gagggcagaguuaagguau

SEQ ID NO: 1964 - RNA, 19 nt, Artificial Sequence
  siRNA Sense Sequence
uaccuuaacucugcccucu

SEQ ID NO: 1965 - RNA, 19 nt, Artificial Sequence
  siRNA Antisense Sequence
agagggcagaguuaaggua

SEQ ID NO: 1966 - RNA, 19 nt, Artificial Sequence
  siRNA Sense Sequence
ucugcccucuaguggcuug

SEQ ID NO: 1967 - RNA, 19 nt, Artificial Sequence
  siRNA Antisense Sequence
caagccacuagagggcaga

SEQ ID NO: 1968 - RNA, 19 nt, Artificial Sequence
  siRNA Sense Sequence
cugcccucuaguggcuuga

SEQ ID NO: 1969 - RNA, 19 nt, Artificial Sequence
  siRNA Antisense Sequence
ucaagccacuagagggcag

SEQ ID NO: 1970 - RNA, 19 nt, Artificial Sequence
  siRNA Sense Sequence
ugcccucuaguggcuugag

SEQ ID NO: 1971 - RNA, 19 nt, Artificial Sequence
  siRNA Antisense Sequence
cucaagccacuagagggca

SEQ ID NO: 1972 - RNA, 19 nt, Artificial Sequence
  siRNA Sense Sequence
agaagucugguguccugaa

SEQ ID NO: 1973 - RNA, 19 nt, Artificial Sequence
  siRNA Antisense Sequence
uucaggacaccagacuucu

SEQ ID NO: 1974 - RNA, 19 nt, Artificial Sequence
  siRNA Sense Sequence
caggacaccagcagcccuu

SEQ ID NO: 1975 - RNA, 19 nt, Artificial Sequence
  siRNA Antisense Sequence
aagggcugcugguguccug

SEQ ID NO: 1976 - RNA, 19 nt, Artificial Sequence
  siRNA Sense Sequence
aggacaccagcagcccuuc

SEQ ID NO: 1977 - RNA, 19 nt, Artificial Sequence
  siRNA Antisense Sequence
gaagggcugcugguguccu

SEQ ID NO: 1978 - RNA, 19 nt, Artificial Sequence
  siRNA Sense Sequence
acaccagcagcccuuccua

SEQ ID NO: 1979 - RNA, 19 nt, Artificial Sequence
  siRNA Antisense Sequence
uaggaagggcugcuggugu

SEQ ID NO: 1980 - RNA, 19 nt, Artificial Sequence
  siRNA Sense Sequence
caccagcagcccuuccuag

SEQ ID NO: 1981 - RNA, 19 nt, Artificial Sequence
  siRNA Antisense Sequence
cuaggaagggcugcuggug

SEQ ID NO: 1982 - RNA, 19 nt, Artificial Sequence
  siRNA Sense Sequence
accagcagcccuuccuaga

SEQ ID NO: 1983 - RNA, 19 nt, Artificial Sequence
  siRNA Antisense Sequence
ucuaggaagggcugcuggu

SEQ ID NO: 1984 - RNA, 19 nt, Artificial Sequence
  siRNA Sense Sequence
ccagcagcccuuccuagag

SEQ ID NO: 1985 - RNA, 19 nt, Artificial Sequence
  siRNA Antisense Sequence
cucuaggaagggcugcugg

SEQ ID NO: 1986 - RNA, 19 nt, Artificial Sequence
  siRNA Sense Sequence
cagcagcccuuccuagagc

SEQ ID NO: 1987 - RNA, 19 nt, Artificial Sequence
  siRNA Antisense Sequence
gcucuaggaagggcugcug

SEQ ID NO: 1988 - RNA, 19 nt, Artificial Sequence
  siRNA Sense Sequence
agcagcccuuccuagagcu

SEQ ID NO: 1989 - RNA, 19 nt, Artificial Sequence
  siRNA Antisense Sequence
agcucuaggaagggcugcu

SEQ ID NO: 1990 - RNA, 19 nt, Artificial Sequence
  siRNA Sense Sequence
gcccuuccuagagcuuaag

SEQ ID NO: 1991 - RNA, 19 nt, Artificial Sequence
  siRNA Antisense Sequence
cuuaagcucuaggaagggc

SEQ ID NO: 1992 - RNA, 19 nt, Artificial Sequence
  siRNA Sense Sequence
cccuuccuagagcuuaaga

SEQ ID NO: 1993 - RNA, 19 nt, Artificial Sequence
  siRNA Antisense Sequence
ucuuaagcucuaggaaggg

SEQ ID NO: 1994 - RNA, 19 nt, Artificial Sequence
  siRNA Sense Sequence
agcuuaagauccgagccaa

SEQ ID NO: 1995 - RNA, 19 nt, Artificial Sequence
  siRNA Antisense Sequence
uuggcucggaucuuaagcu

SEQ ID NO: 1996 - RNA, 19 nt, Artificial Sequence
  siRNA Sense Sequence
gcuuaagauccgagccaau

SEQ ID NO: 1997 - RNA, 19 nt, Artificial Sequence
  siRNA Antisense Sequence
auuggcucggaucuuaagc

SEQ ID NO: 1998 - RNA, 19 nt, Artificial Sequence
  siRNA Sense Sequence
cuuaagauccgagccaaug

SEQ ID NO: 1999 - RNA, 19 nt, Artificial Sequence
  siRNA Antisense Sequence
cauuggcucggaucuuaag

SEQ ID NO: 2000 - RNA, 19 nt, Artificial Sequence
  siRNA Sense Sequence
uuaagauccgagccaauga

SEQ ID NO: 2001 - RNA, 19 nt, Artificial Sequence
  siRNA Antisense Sequence
ucauuggcucggaucuuaa

SEQ ID NO: 2002 - RNA, 19 nt, Artificial Sequence
  siRNA Sense Sequence
uaagauccgagccaaugag

SEQ ID NO: 2003 - RNA, 19 nt, Artificial Sequence
  siRNA Antisense Sequence
cucauuggcucggaucuua

SEQ ID NO: 2004 - RNA, 19 nt, Artificial Sequence
  siRNA Sense Sequence
cgagccaaugagccuggag

SEQ ID NO: 2005 - RNA, 19 nt, Artificial Sequence
  siRNA Antisense Sequence
cuccaggcucauuggcucg

SEQ ID NO: 2006 - RNA, 19 nt, Artificial Sequence
  siRNA Sense Sequence
cccuuauguugcaggcgag

SEQ ID NO: 2007 - RNA, 19 nt, Artificial Sequence
  siRNA Antisense Sequence
cucgccugcaacauaaggg

SEQ ID NO: 2008 - RNA, 19 nt, Artificial Sequence
  siRNA Sense Sequence
cauuacguagacuuccagg

SEQ ID NO: 2009 - RNA, 19 nt, Artificial Sequence
  siRNA Antisense Sequence
ccuggaagucuacguaaug

SEQ ID NO: 2010 - RNA, 19 nt, Artificial Sequence
  siRNA Sense Sequence
auuacguagacuuccagga

SEQ ID NO: 2011 - RNA, 19 nt, Artificial Sequence
  siRNA Antisense Sequence
uccuggaagucuacguaau

SEQ ID NO: 2012 - RNA, 19 nt, Artificial Sequence
  siRNA Sense Sequence
uuacguagacuuccaggaa

SEQ ID NO: 2013 - RNA, 19 nt, Artificial Sequence
  siRNA Antisense Sequence
uuccuggaagucuacguaa

SEQ ID NO: 2014 - RNA, 19 nt, Artificial Sequence
  siRNA Sense Sequence
acuggauacugcagcccga

SEQ ID NO: 2015 - RNA, 19 nt, Artificial Sequence
  siRNA Antisense Sequence
ucgggcugcaguauccagu

SEQ ID NO: 2016 - RNA, 19 nt, Artificial Sequence
  siRNA Sense Sequence
cuggauacugcagcccgag

SEQ ID NO: 2017 - RNA, 19 nt, Artificial Sequence
  siRNA Antisense Sequence
cucgggcugcaguauccag

SEQ ID NO: 2018 - RNA, 19 nt, Artificial Sequence
  siRNA Sense Sequence
uggauacugcagcccgagg

SEQ ID NO: 2019 - RNA, 19 nt, Artificial Sequence
  siRNA Antisense Sequence
ccucgggcugcaguaucca

SEQ ID NO: 2020 - RNA, 19 nt, Artificial Sequence
  siRNA Sense Sequence
ggguaccagcugaauuacu

SEQ ID NO: 2021 - RNA, 19 nt, Artificial Sequence
  siRNA Antisense Sequence
aguaauucagcugguaccc

SEQ ID NO: 2022 - RNA, 19 nt, Artificial Sequence
  siRNA Sense Sequence
cugaauuacugcagugggc

SEQ ID NO: 2023 - RNA, 19 nt, Artificial Sequence
  siRNA Antisense Sequence
gcccacugcaguaauucag

SEQ ID NO: 2024 - RNA, 19 nt, Artificial Sequence
  siRNA Sense Sequence
ugaauuacugcagugggca

SEQ ID NO: 2025 - RNA, 19 nt, Artificial Sequence
  siRNA Antisense Sequence
ugcccacugcaguaauuca

SEQ ID NO: 2026 - RNA, 19 nt, Artificial Sequence
  siRNA Sense Sequence
uggcagcccaggcauugcu

SEQ ID NO: 2027 - RNA, 19 nt, Artificial Sequence
  siRNA Antisense Sequence
agcaaugccugggcugcca

SEQ ID NO: 2028 - RNA, 19 nt, Artificial Sequence
  siRNA Sense Sequence
gcauugcugccucuuucca

SEQ ID NO: 2029 - RNA, 19 nt, Artificial Sequence
  siRNA Antisense Sequence
uggaaagaggcagcaaugc

SEQ ID NO: 2030 - RNA, 19 nt, Artificial Sequence
  siRNA Sense Sequence
cauugcugccucuuuccau

SEQ ID NO: 2031 - RNA, 19 nt, Artificial Sequence
  siRNA Antisense Sequence
auggaaagaggcagcaaug

SEQ ID NO: 2032 - RNA, 19 nt, Artificial Sequence
  siRNA Sense Sequence
auugcugccucuuuccauu

SEQ ID NO: 2033 - RNA, 19 nt, Artificial Sequence
  siRNA Antisense Sequence
aauggaaagaggcagcaau

SEQ ID NO: 2034 - RNA, 19 nt, Artificial Sequence
  siRNA Sense Sequence
ugcugccucuuuccauucu

SEQ ID NO: 2035 - RNA, 19 nt, Artificial Sequence
  siRNA Antisense Sequence
agaauggaaagaggcagca

SEQ ID NO: 2036 - RNA, 19 nt, Artificial Sequence
  siRNA Sense Sequence
gcugccucuuuccauucug

SEQ ID NO: 2037 - RNA, 19 nt, Artificial Sequence
  siRNA Antisense Sequence
cagaauggaaagaggcagc

SEQ ID NO: 2038 - RNA, 19 nt, Artificial Sequence
  siRNA Sense Sequence
cugccucuuuccauucugc

SEQ ID NO: 2039 - RNA, 19 nt, Artificial Sequence
  siRNA Antisense Sequence
gcagaauggaaagaggcag

SEQ ID NO: 2040 - RNA, 19 nt, Artificial Sequence
  siRNA Sense Sequence
ugccucuuuccauucugcc

SEQ ID NO: 2041 - RNA, 19 nt, Artificial Sequence
  siRNA Antisense Sequence
ggcagaauggaaagaggca

SEQ ID NO: 2042 - RNA, 19 nt, Artificial Sequence
  siRNA Sense Sequence
gccucuuuccauucugccg

SEQ ID NO: 2043 - RNA, 19 nt, Artificial Sequence
  siRNA Antisense Sequence
cggcagaauggaaagaggc

SEQ ID NO: 2044 - RNA, 19 nt, Artificial Sequence
  siRNA Sense Sequence
ccucuuuccauucugccgu

SEQ ID NO: 2045 - RNA, 19 nt, Artificial Sequence
  siRNA Antisense Sequence
acggcagaauggaaagagg

SEQ ID NO: 2046 - RNA, 19 nt, Artificial Sequence
  siRNA Sense Sequence
cucuuuccauucugccguc

SEQ ID NO: 2047 - RNA, 19 nt, Artificial Sequence
  siRNA Antisense Sequence
gacggcagaauggaaagag

SEQ ID NO: 2048 - RNA, 19 nt, Artificial Sequence
  siRNA Sense Sequence
cauucugccgucuucagcc

SEQ ID NO: 2049 - RNA, 19 nt, Artificial Sequence
  siRNA Antisense Sequence
ggcugaagacggcagaaug

SEQ ID NO: 2050 - RNA, 19 nt, Artificial Sequence
  siRNA Sense Sequence
cuucagccuccucaaagcc

SEQ ID NO: 2051 - RNA, 19 nt, Artificial Sequence
  siRNA Antisense Sequence
ggcuuugaggaggcugaag

SEQ ID NO: 2052 - RNA, 19 nt, Artificial Sequence
  siRNA Sense Sequence
uucagccuccucaaagcca

SEQ ID NO: 2053 - RNA, 19 nt, Artificial Sequence
  siRNA Antisense Sequence
uggcuuugaggaggcugaa

SEQ ID NO: 2054 - RNA, 19 nt, Artificial Sequence
  siRNA Sense Sequence
ucagccuccucaaagccaa

SEQ ID NO: 2055 - RNA, 19 nt, Artificial Sequence
  siRNA Antisense Sequence
uuggcuuugaggaggcuga

SEQ ID NO: 2056 - RNA, 19 nt, Artificial Sequence
  siRNA Sense Sequence
cagccuccucaaagccaac

SEQ ID NO: 2057 - RNA, 19 nt, Artificial Sequence
  siRNA Antisense Sequence
guuggcuuugaggaggcug

SEQ ID NO: 2058 - RNA, 19 nt, Artificial Sequence
  siRNA Sense Sequence
uccuuggccugccaguacc

SEQ ID NO: 2059 - RNA, 19 nt, Artificial Sequence
  siRNA Antisense Sequence
gguacuggcaggccaagga

SEQ ID NO: 2060 - RNA, 19 nt, Artificial Sequence
  siRNA Sense Sequence
ccugccaguaccuccuguu

SEQ ID NO: 2061 - RNA, 19 nt, Artificial Sequence
  siRNA Antisense Sequence
aacaggagguacuggcagg

SEQ ID NO: 2062 - RNA, 19 nt, Artificial Sequence
  siRNA Sense Sequence
cugccaguaccuccuguug

SEQ ID NO: 2063 - RNA, 19 nt, Artificial Sequence
  siRNA Antisense Sequence
caacaggagguacuggcag

SEQ ID NO: 2064 - RNA, 19 nt, Artificial Sequence
  siRNA Sense Sequence
ugccaguaccuccuguugu

SEQ ID NO: 2065 - RNA, 19 nt, Artificial Sequence
  siRNA Antisense Sequence
acaacaggagguacuggca

SEQ ID NO: 2066 - RNA, 19 nt, Artificial Sequence
  siRNA Sense Sequence
gccaguaccuccuguugug

SEQ ID NO: 2067 - RNA, 19 nt, Artificial Sequence
  siRNA Antisense Sequence
cacaacaggagguacuggc

SEQ ID NO: 2068 - RNA, 19 nt, Artificial Sequence
  siRNA Sense Sequence
ccaguaccuccuguugugu

SEQ ID NO: 2069 - RNA, 19 nt, Artificial Sequence
  siRNA Antisense Sequence
acacaacaggagguacugg

SEQ ID NO: 2070 - RNA, 19 nt, Artificial Sequence
  siRNA Sense Sequence
caguaccuccuguuguguc

SEQ ID NO: 2071 - RNA, 19 nt, Artificial Sequence
  siRNA Antisense Sequence
gacacaacaggagguacug

SEQ ID NO: 2072 - RNA, 19 nt, Artificial Sequence
  siRNA Sense Sequence
guaccuccuguuguguccc

SEQ ID NO: 2073 - RNA, 19 nt, Artificial Sequence
  siRNA Antisense Sequence
gggacacaacaggagguac

SEQ ID NO: 2074 - RNA, 19 nt, Artificial Sequence
  siRNA Sense Sequence
uaccuccuguugugucccu

SEQ ID NO: 2075 - RNA, 19 nt, Artificial Sequence
  siRNA Antisense Sequence
agggacacaacaggaggua

SEQ ID NO: 2076 - RNA, 19 nt, Artificial Sequence
  siRNA Sense Sequence
accuccuguugugucccua

SEQ ID NO: 2077 - RNA, 19 nt, Artificial Sequence
  siRNA Antisense Sequence
uagggacacaacaggaggu

SEQ ID NO: 2078 - RNA, 19 nt, Artificial Sequence
  siRNA Sense Sequence
ccuccuguugugucccuac

SEQ ID NO: 2079 - RNA, 19 nt, Artificial Sequence
  siRNA Antisense Sequence
guagggacacaacaggagg

SEQ ID NO: 2080 - RNA, 19 nt, Artificial Sequence
  siRNA Sense Sequence
cuccuguugugucccuacu

SEQ ID NO: 2081 - RNA, 19 nt, Artificial Sequence
  siRNA Antisense Sequence
aguagggacacaacaggag

SEQ ID NO: 2082 - RNA, 19 nt, Artificial Sequence
  siRNA Sense Sequence
uugugucccuacugcccga

SEQ ID NO: 2083 - RNA, 19 nt, Artificial Sequence
  siRNA Antisense Sequence
ucgggcaguagggacacaa

SEQ ID NO: 2084 - RNA, 19 nt, Artificial Sequence
  siRNA Sense Sequence
ugugucccuacugcccgaa

SEQ ID NO: 2085 - RNA, 19 nt, Artificial Sequence
  siRNA Antisense Sequence
uucgggcaguagggacaca

SEQ ID NO: 2086 - RNA, 19 nt, Artificial Sequence
  siRNA Sense Sequence
gugucccuacugcccgaag

SEQ ID NO: 2087 - RNA, 19 nt, Artificial Sequence
  siRNA Antisense Sequence
cuucgggcaguagggacac

SEQ ID NO: 2088 - RNA, 19 nt, Artificial Sequence
  siRNA Sense Sequence
ugucccuacugcccgaagg

SEQ ID NO: 2089 - RNA, 19 nt, Artificial Sequence
  siRNA Antisense Sequence
ccuucgggcaguagggaca

SEQ ID NO: 2090 - RNA, 19 nt, Artificial Sequence
  siRNA Sense Sequence
ucucucuccucuaccugga

SEQ ID NO: 2091 - RNA, 19 nt, Artificial Sequence
  siRNA Antisense Sequence
uccagguagaggagagaga

SEQ ID NO: 2092 - RNA, 19 nt, Artificial Sequence
  siRNA Sense Sequence
ucuccucuaccuggaucau

SEQ ID NO: 2093 - RNA, 19 nt, Artificial Sequence
  siRNA Antisense Sequence
augauccagguagaggaga

SEQ ID NO: 2094 - RNA, 19 nt, Artificial Sequence
  siRNA Sense Sequence
cuccucuaccuggaucaua

SEQ ID NO: 2095 - RNA, 19 nt, Artificial Sequence
  siRNA Antisense Sequence
uaugauccagguagaggag

SEQ ID NO: 2096 - RNA, 19 nt, Artificial Sequence
  siRNA Sense Sequence
uccucuaccuggaucauaa

SEQ ID NO: 2097 - RNA, 19 nt, Artificial Sequence
  siRNA Antisense Sequence
uuaugauccagguagagga

SEQ ID NO: 2098 - RNA, 19 nt, Artificial Sequence
  siRNA Sense Sequence
ccucuaccuggaucauaau

SEQ ID NO: 2099 - RNA, 19 nt, Artificial Sequence
  siRNA Antisense Sequence
auuaugauccagguagagg

SEQ ID NO: 2100 - RNA, 19 nt, Artificial Sequence
  siRNA Sense Sequence
cucuaccuggaucauaaug

SEQ ID NO: 2101 - RNA, 19 nt, Artificial Sequence
  siRNA Antisense Sequence
cauuaugauccagguagag

SEQ ID NO: 2102 - RNA, 19 nt, Artificial Sequence
  siRNA Sense Sequence
ucuaccuggaucauaaugg

SEQ ID NO: 2103 - RNA, 19 nt, Artificial Sequence
  siRNA Antisense Sequence
ccauuaugauccagguaga

SEQ ID NO: 2104 - RNA, 19 nt, Artificial Sequence
  siRNA Sense Sequence
cuaccuggaucauaauggc

SEQ ID NO: 2105 - RNA, 19 nt, Artificial Sequence
  siRNA Antisense Sequence
gccauuaugauccagguag

SEQ ID NO: 2106 - RNA, 19 nt, Artificial Sequence
  siRNA Sense Sequence
uaccuggaucauaauggca

SEQ ID NO: 2107 - RNA, 19 nt, Artificial Sequence
  siRNA Antisense Sequence
ugccauuaugauccaggua

SEQ ID NO: 2108 - RNA, 19 nt, Artificial Sequence
  siRNA Sense Sequence
accuggaucauaauggcaa

SEQ ID NO: 2109 - RNA, 19 nt, Artificial Sequence
  siRNA Antisense Sequence
uugccauuaugauccaggu

SEQ ID NO: 2110 - RNA, 19 nt, Artificial Sequence
  siRNA Sense Sequence
ccuggaucauaauggcaau

SEQ ID NO: 2111 - RNA, 19 nt, Artificial Sequence
  siRNA Antisense Sequence
auugccauuaugauccagg

SEQ ID NO: 2112 - RNA, 19 nt, Artificial Sequence
  siRNA Sense Sequence
cuggaucauaauggcaaug

SEQ ID NO: 2113 - RNA, 19 nt, Artificial Sequence
  siRNA Antisense Sequence
cauugccauuaugauccag

SEQ ID NO: 2114 - RNA, 19 nt, Artificial Sequence
  siRNA Sense Sequence
uggaucauaauggcaaugu

SEQ ID NO: 2115 - RNA, 19 nt, Artificial Sequence
  siRNA Antisense Sequence
acauugccauuaugaucca

SEQ ID NO: 2116 - RNA, 19 nt, Artificial Sequence
  siRNA Sense Sequence
ggaucauaauggcaaugug

SEQ ID NO: 2117 - RNA, 19 nt, Artificial Sequence
  siRNA Antisense Sequence
cacauugccauuaugaucc

SEQ ID NO: 2118 - RNA, 19 nt, Artificial Sequence
  siRNA Sense Sequence
gaucauaauggcaaugugg

SEQ ID NO: 2119 - RNA, 19 nt, Artificial Sequence
  siRNA Antisense Sequence
ccacauugccauuaugauc

SEQ ID NO: 2120 - RNA, 19 nt, Artificial Sequence
  siRNA Sense Sequence
auaauggcaauguggucaa

SEQ ID NO: 2121 - RNA, 19 nt, Artificial Sequence
  siRNA Antisense Sequence
uugaccacauugccauuau

SEQ ID NO: 2122 - RNA, 19 nt, Artificial Sequence
  siRNA Sense Sequence
uaauggcaauguggucaag

SEQ ID NO: 2123 - RNA, 19 nt, Artificial Sequence
  siRNA Antisense Sequence
cuugaccacauugccauua

SEQ ID NO: 2124 - RNA, 19 nt, Artificial Sequence
  siRNA Sense Sequence
aauggcaauguggucaaga

SEQ ID NO: 2125 - RNA, 19 nt, Artificial Sequence
  siRNA Antisense Sequence
ucuugaccacauugccauu

SEQ ID NO: 2126 - RNA, 19 nt, Artificial Sequence
  siRNA Sense Sequence
aauguggucaagacggaug

SEQ ID NO: 2127 - RNA, 19 nt, Artificial Sequence
  siRNA Antisense Sequence
cauccgucuugaccacauu

SEQ ID NO: 2128 - RNA, 19 nt, Artificial Sequence
  siRNA Sense Sequence
auguggucaagacggaugu

SEQ ID NO: 2129 - RNA, 19 nt, Artificial Sequence
  siRNA Antisense Sequence
acauccgucuugaccacau

SEQ ID NO: 2130 - RNA, 19 nt, Artificial Sequence
  siRNA Sense Sequence
uguggucaagacggaugug

SEQ ID NO: 2131 - RNA, 19 nt, Artificial Sequence
  siRNA Antisense Sequence
cacauccgucuugaccaca

SEQ ID NO: 2132 - RNA, 19 nt, Artificial Sequence
  siRNA Sense Sequence
guggucaagacggaugugc

SEQ ID NO: 2133 - RNA, 19 nt, Artificial Sequence
  siRNA Antisense Sequence
gcacauccgucuugaccac

SEQ ID NO: 2134 - RNA, 19 nt, Artificial Sequence
  siRNA Sense Sequence
uggucaagacggaugugcc

SEQ ID NO: 2135 - RNA, 19 nt, Artificial Sequence
  siRNA Antisense Sequence
ggcacauccgucuugacca

SEQ ID NO: 2136 - RNA, 19 nt, Artificial Sequence
  siRNA Sense Sequence
ggucaagacggaugugcca

SEQ ID NO: 2137 - RNA, 19 nt, Artificial Sequence
  siRNA Antisense Sequence
uggcacauccgucuugacc

SEQ ID NO: 2138 - RNA, 19 nt, Artificial Sequence
  siRNA Sense Sequence
gucaagacggaugugccag

SEQ ID NO: 2139 - RNA, 19 nt, Artificial Sequence
  siRNA Antisense Sequence
cuggcacauccgucuugac

SEQ ID NO: 2140 - RNA, 19 nt, Artificial Sequence
  siRNA Sense Sequence
ucaagacggaugugccaga

SEQ ID NO: 2141 - RNA, 19 nt, Artificial Sequence
  siRNA Antisense Sequence
ucuggcacauccgucuuga

SEQ ID NO: 2142 - RNA, 19 nt, Artificial Sequence
  siRNA Sense Sequence
caagacggaugugccagau

SEQ ID NO: 2143 - RNA, 19 nt, Artificial Sequence
  siRNA Antisense Sequence
aucuggcacauccgucuug

SEQ ID NO: 2144 - RNA, 19 nt, Artificial Sequence
  siRNA Sense Sequence
aagacggaugugccagaua

SEQ ID NO: 2145 - RNA, 19 nt, Artificial Sequence
  siRNA Antisense Sequence
uaucuggcacauccgucuu

SEQ ID NO: 2146 - RNA, 19 nt, Artificial Sequence
  siRNA Sense Sequence
agacggaugugccagauau

SEQ ID NO: 2147 - RNA, 19 nt, Artificial Sequence
  siRNA Antisense Sequence
auaucuggcacauccgucu

SEQ ID NO: 2148 - RNA, 19 nt, Artificial Sequence
  siRNA Sense Sequence
gacggaugugccagauaug

SEQ ID NO: 2149 - RNA, 19 nt, Artificial Sequence
  siRNA Antisense Sequence
cauaucuggcacauccguc

SEQ ID NO: 2150 - RNA, 19 nt, Artificial Sequence
  siRNA Sense Sequence
acggaugugccagauaugg

SEQ ID NO: 2151 - RNA, 19 nt, Artificial Sequence
  siRNA Antisense Sequence
ccauaucuggcacauccgu

SEQ ID NO: 2152 - RNA, 19 nt, Artificial Sequence
  siRNA Sense Sequence
cggaugugccagauauggu

SEQ ID NO: 2153 - RNA, 19 nt, Artificial Sequence
  siRNA Antisense Sequence
accauaucuggcacauccg

SEQ ID NO: 2154 - RNA, 19 nt, Artificial Sequence
  siRNA Sense Sequence
ggaugugccagauauggug

SEQ ID NO: 2155 - RNA, 19 nt, Artificial Sequence
  siRNA Antisense Sequence
caccauaucuggcacaucc

SEQ ID NO: 2156 - RNA, 19 nt, Artificial Sequence
  siRNA Sense Sequence
gaugugccagauauggugg

SEQ ID NO: 2157 - RNA, 19 nt, Artificial Sequence
  siRNA Antisense Sequence
ccaccauaucuggcacauc

SEQ ID NO: 2158 - RNA, 19 nt, Artificial Sequence
  siRNA Sense Sequence
gccagauauggugguggag

SEQ ID NO: 2159 - RNA, 19 nt, Artificial Sequence
  siRNA Antisense Sequence
cuccaccaccauaucuggc

SEQ ID NO: 2160 - RNA, 19 nt, Artificial Sequence
  siRNA Sense Sequence
ccagauauggugguggagg

SEQ ID NO: 2161 - RNA, 19 nt, Artificial Sequence
  siRNA Antisense Sequence
ccuccaccaccauaucugg

SEQ ID NO: 2162 - RNA, 19 nt, Artificial Sequence
  siRNA Sense Sequence
cagauauggugguggaggc

SEQ ID NO: 2163 - RNA, 19 nt, Artificial Sequence
  siRNA Antisense Sequence
gccuccaccaccauaucug

SEQ ID NO: 2164 - RNA, 19 nt, Artificial Sequence
  siRNA Sense Sequence
agauauggugguggaggcc

SEQ ID NO: 2165 - RNA, 19 nt, Artificial Sequence
  siRNA Antisense Sequence
ggccuccaccaccauaucu

SEQ ID NO: 2166 - RNA, 19 nt, Artificial Sequence
  siRNA Sense Sequence
gauauggugguggaggccu

SEQ ID NO: 2167 - RNA, 19 nt, Artificial Sequence
  siRNA Antisense Sequence
aggccuccaccaccauauc

SEQ ID NO: 2168 - RNA, 19 nt, Artificial Sequence
  siRNA Sense Sequence
auauggugguggaggccug

SEQ ID NO: 2169 - RNA, 19 nt, Artificial Sequence
  siRNA Antisense Sequence
caggccuccaccaccauau

SEQ ID NO: 2170 - RNA, 19 nt, Artificial Sequence
  siRNA Sense Sequence
ccuguggcugcagcuagca

SEQ ID NO: 2171 - RNA, 19 nt, Artificial Sequence
  siRNA Antisense Sequence
ugcuagcugcagccacagg

SEQ ID NO: 2172 - RNA, 19 nt, Artificial Sequence
  siRNA Sense Sequence
uguggcugcagcuagcaag

SEQ ID NO: 2173 - RNA, 19 nt, Artificial Sequence
  siRNA Antisense Sequence
cuugcuagcugcagccaca

SEQ ID NO: 2174 - RNA, 19 nt, Artificial Sequence
  siRNA Sense Sequence
guggcugcagcuagcaaga

SEQ ID NO: 2175 - RNA, 19 nt, Artificial Sequence
  siRNA Antisense Sequence
ucuugcuagcugcagccac

SEQ ID NO: 2176 - RNA, 19 nt, Artificial Sequence
  siRNA Sense Sequence
uggcugcagcuagcaagag

SEQ ID NO: 2177 - RNA, 19 nt, Artificial Sequence
  siRNA Antisense Sequence
cucuugcuagcugcagcca

SEQ ID NO: 2178 - RNA, 19 nt, Artificial Sequence
  siRNA Sense Sequence
ggcugcagcuagcaagagg

SEQ ID NO: 2179 - RNA, 19 nt, Artificial Sequence
  siRNA Antisense Sequence
ccucuugcuagcugcagcc

SEQ ID NO: 2180 - RNA, 19 nt, Artificial Sequence
  siRNA Sense Sequence
cugcagcuagcaagaggac

SEQ ID NO: 2181 - RNA, 19 nt, Artificial Sequence
  siRNA Antisense Sequence
guccucuugcuagcugcag

SEQ ID NO: 2182 - RNA, 19 nt, Artificial Sequence
  siRNA Sense Sequence
cagcuagcaagaggaccug

SEQ ID NO: 2183 - RNA, 19 nt, Artificial Sequence
  siRNA Antisense Sequence
cagguccucuugcuagcug

SEQ ID NO: 2184 - RNA, 19 nt, Artificial Sequence
  siRNA Sense Sequence
gcuagcaagaggaccuggg

SEQ ID NO: 2185 - RNA, 19 nt, Artificial Sequence
  siRNA Antisense Sequence
cccagguccucuugcuagc

SEQ ID NO: 2186 - RNA, 19 nt, Artificial Sequence
  siRNA Sense Sequence
agaccaagaugaaguuucc

SEQ ID NO: 2187 - RNA, 19 nt, Artificial Sequence
  siRNA Antisense Sequence
ggaaacuucaucuuggucu

SEQ ID NO: 2188 - RNA, 19 nt, Artificial Sequence
  siRNA Sense Sequence
ugaaguuucccaggcacag

SEQ ID NO: 2189 - RNA, 19 nt, Artificial Sequence
  siRNA Antisense Sequence
cugugccugggaaacuuca

SEQ ID NO: 2190 - RNA, 19 nt, Artificial Sequence
  siRNA Sense Sequence
gaaguuucccaggcacagg

SEQ ID NO: 2191 - RNA, 19 nt, Artificial Sequence
  siRNA Antisense Sequence
ccugugccugggaaacuuc

SEQ ID NO: 2192 - RNA, 19 nt, Artificial Sequence
  siRNA Sense Sequence
ucccaggcacagggcaucu

SEQ ID NO: 2193 - RNA, 19 nt, Artificial Sequence
  siRNA Antisense Sequence
agaugcccugugccuggga

SEQ ID NO: 2194 - RNA, 19 nt, Artificial Sequence
  siRNA Sense Sequence
ggcaucugugacuggaggc

SEQ ID NO: 2195 - RNA, 19 nt, Artificial Sequence
  siRNA Antisense Sequence
gccuccagucacagaugcc

SEQ ID NO: 2196 - RNA, 19 nt, Artificial Sequence
  siRNA Sense Sequence
gcaucugugacuggaggca

SEQ ID NO: 2197 - RNA, 19 nt, Artificial Sequence
  siRNA Antisense Sequence
ugccuccagucacagaugc

SEQ ID NO: 2198 - RNA, 19 nt, Artificial Sequence
  siRNA Sense Sequence
caaccaccuggcaauauga

SEQ ID NO: 2199 - RNA, 19 nt, Artificial Sequence
  siRNA Antisense Sequence
ucauauugccaggugguug

SEQ ID NO: 2200 - RNA, 19 nt, Artificial Sequence
  siRNA Sense Sequence
aaccaccuggcaauaugac

SEQ ID NO: 2201 - RNA, 19 nt, Artificial Sequence
  siRNA Antisense Sequence
gucauauugccaggugguu

SEQ ID NO: 2202 - RNA, 19 nt, Artificial Sequence
  siRNA Sense Sequence
accaccuggcaauaugacu

SEQ ID NO: 2203 - RNA, 19 nt, Artificial Sequence
  siRNA Antisense Sequence
agucauauugccagguggu

SEQ ID NO: 2204 - RNA, 19 nt, Artificial Sequence
  siRNA Sense Sequence
ccaccuggcaauaugacuc

SEQ ID NO: 2205 - RNA, 19 nt, Artificial Sequence
  siRNA Antisense Sequence
gagucauauugccaggugg

SEQ ID NO: 2206 - RNA, 19 nt, Artificial Sequence
  siRNA Sense Sequence
caccuggcaauaugacuca

SEQ ID NO: 2207 - RNA, 19 nt, Artificial Sequence
  siRNA Antisense Sequence
ugagucauauugccaggug

SEQ ID NO: 2208 - RNA, 19 nt, Artificial Sequence
  siRNA Sense Sequence
accuggcaauaugacucac

SEQ ID NO: 2209 - RNA, 19 nt, Artificial Sequence
  siRNA Antisense Sequence
gugagucauauugccaggu

SEQ ID NO: 2210 - RNA, 19 nt, Artificial Sequence
  siRNA Sense Sequence
ccuggcaauaugacucacu

SEQ ID NO: 2211 - RNA, 19 nt, Artificial Sequence
  siRNA Antisense Sequence
agugagucauauugccagg

SEQ ID NO: 2212 - RNA, 19 nt, Artificial Sequence
  siRNA Sense Sequence
cuggcaauaugacucacuu

SEQ ID NO: 2213 - RNA, 19 nt, Artificial Sequence
  siRNA Antisense Sequence
aagugagucauauugccag

SEQ ID NO: 2214 - RNA, 19 nt, Artificial Sequence
  siRNA Sense Sequence
uggcaauaugacucacuug

SEQ ID NO: 2215 - RNA, 19 nt, Artificial Sequence
  siRNA Antisense Sequence
caagugagucauauugcca

SEQ ID NO: 2216 - RNA, 19 nt, Artificial Sequence
  siRNA Sense Sequence
aauaugacucacuugaccc

SEQ ID NO: 2217 - RNA, 19 nt, Artificial Sequence
  siRNA Antisense Sequence
gggucaagugagucauauu

SEQ ID NO: 2218 - RNA, 19 nt, Artificial Sequence
  siRNA Sense Sequence
cccuaugggacccaaaugg

SEQ ID NO: 2219 - RNA, 19 nt, Artificial Sequence
  siRNA Antisense Sequence
ccauuugggucccauaggg

SEQ ID NO: 2220 - RNA, 19 nt, Artificial Sequence
  siRNA Sense Sequence
ccuaugggacccaaauggg

SEQ ID NO: 2221 - RNA, 19 nt, Artificial Sequence
  siRNA Antisense Sequence
cccauuugggucccauagg

SEQ ID NO: 2222 - RNA, 19 nt, Artificial Sequence
  siRNA Sense Sequence
cuaugggacccaaaugggc

SEQ ID NO: 2223 - RNA, 19 nt, Artificial Sequence
  siRNA Antisense Sequence
gcccauuugggucccauag

SEQ ID NO: 2224 - RNA, 19 nt, Artificial Sequence
  siRNA Sense Sequence
uaugggacccaaaugggca

SEQ ID NO: 2225 - RNA, 19 nt, Artificial Sequence
  siRNA Antisense Sequence
ugcccauuugggucccaua

SEQ ID NO: 2226 - RNA, 19 nt, Artificial Sequence
  siRNA Sense Sequence
augggacccaaaugggcac

SEQ ID NO: 2227 - RNA, 19 nt, Artificial Sequence
  siRNA Antisense Sequence
gugcccauuugggucccau

SEQ ID NO: 2228 - RNA, 19 nt, Artificial Sequence
  siRNA Sense Sequence
cccaaaugggcacuuucuu

SEQ ID NO: 2229 - RNA, 19 nt, Artificial Sequence
  siRNA Antisense Sequence
aagaaagugcccauuuggg

SEQ ID NO: 2230 - RNA, 19 nt, Artificial Sequence
  siRNA Sense Sequence
ccaaaugggcacuuucuug

SEQ ID NO: 2231 - RNA, 19 nt, Artificial Sequence
  siRNA Antisense Sequence
caagaaagugcccauuugg

SEQ ID NO: 2232 - RNA, 19 nt, Artificial Sequence
  siRNA Sense Sequence
caaaugggcacuuucuugu

SEQ ID NO: 2233 - RNA, 19 nt, Artificial Sequence
  siRNA Antisense Sequence
acaagaaagugcccauuug

SEQ ID NO: 2234 - RNA, 19 nt, Artificial Sequence
  siRNA Sense Sequence
aaaugggcacuuucuuguc

SEQ ID NO: 2235 - RNA, 19 nt, Artificial Sequence
  siRNA Antisense Sequence
gacaagaaagugcccauuu

SEQ ID NO: 2236 - RNA, 19 nt, Artificial Sequence
  siRNA Sense Sequence
aaugggcacuuucuugucu

SEQ ID NO: 2237 - RNA, 19 nt, Artificial Sequence
  siRNA Antisense Sequence
agacaagaaagugcccauu

SEQ ID NO: 2238 - RNA, 19 nt, Artificial Sequence
  siRNA Sense Sequence
ugggcacuuucuugucuga

SEQ ID NO: 2239 - RNA, 19 nt, Artificial Sequence
  siRNA Antisense Sequence
ucagacaagaaagugccca

SEQ ID NO: 2240 - RNA, 19 nt, Artificial Sequence
  siRNA Sense Sequence
gggcacuuucuugucugag

SEQ ID NO: 2241 - RNA, 19 nt, Artificial Sequence
  siRNA Antisense Sequence
cucagacaagaaagugccc

SEQ ID NO: 2242 - RNA, 19 nt, Artificial Sequence
  siRNA Sense Sequence
uggcuuauuccagguuggc

SEQ ID NO: 2243 - RNA, 19 nt, Artificial Sequence
  siRNA Antisense Sequence
gccaaccuggaauaagcca

SEQ ID NO: 2244 - RNA, 19 nt, Artificial Sequence
  siRNA Sense Sequence
ggcuuauuccagguuggcu

SEQ ID NO: 2245 - RNA, 19 nt, Artificial Sequence
  siRNA Antisense Sequence
agccaaccuggaauaagcc

SEQ ID NO: 2246 - RNA, 19 nt, Artificial Sequence
  siRNA Sense Sequence
gcuuauuccagguuggcug

SEQ ID NO: 2247 - RNA, 19 nt, Artificial Sequence
  siRNA Antisense Sequence
cagccaaccuggaauaagc

SEQ ID NO: 2248 - RNA, 19 nt, Artificial Sequence
  siRNA Sense Sequence
cuuauuccagguuggcuga

SEQ ID NO: 2249 - RNA, 19 nt, Artificial Sequence
  siRNA Antisense Sequence
ucagccaaccuggaauaag

SEQ ID NO: 2250 - RNA, 19 nt, Artificial Sequence
  siRNA Sense Sequence
uuccagguuggcugaugug

SEQ ID NO: 2251 - RNA, 19 nt, Artificial Sequence
  siRNA Antisense Sequence
cacaucagccaaccuggaa

SEQ ID NO: 2252 - RNA, 19 nt, Artificial Sequence
  siRNA Sense Sequence
uccagguuggcugaugugu

SEQ ID NO: 2253 - RNA, 19 nt, Artificial Sequence
  siRNA Antisense Sequence
acacaucagccaaccugga

SEQ ID NO: 2254 - RNA, 19 nt, Artificial Sequence
  siRNA Sense Sequence
ccagguuggcugauguguu

SEQ ID NO: 2255 - RNA, 19 nt, Artificial Sequence
  siRNA Antisense Sequence
aacacaucagccaaccugg

SEQ ID NO: 2256 - RNA, 19 nt, Artificial Sequence
  siRNA Sense Sequence
cagguuggcugauguguug

SEQ ID NO: 2257 - RNA, 19 nt, Artificial Sequence
  siRNA Antisense Sequence
caacacaucagccaaccug

SEQ ID NO: 2258 - RNA, 19 nt, Artificial Sequence
  siRNA Sense Sequence
agguuggcugauguguugg

SEQ ID NO: 2259 - RNA, 19 nt, Artificial Sequence
  siRNA Antisense Sequence
ccaacacaucagccaaccu

SEQ ID NO: 2260 - RNA, 19 nt, Artificial Sequence
  siRNA Sense Sequence
gguuggcugauguguuggg

SEQ ID NO: 2261 - RNA, 19 nt, Artificial Sequence
  siRNA Antisense Sequence
cccaacacaucagccaacc

SEQ ID NO: 2262 - RNA, 19 nt, Artificial Sequence
  siRNA Sense Sequence
agauggguaaagcguuucu

SEQ ID NO: 2263 - RNA, 19 nt, Artificial Sequence
  siRNA Antisense Sequence
agaaacgcuuuacccaucu

SEQ ID NO: 2264 - RNA, 19 nt, Artificial Sequence
  siRNA Sense Sequence
gauggguaaagcguuucuu

SEQ ID NO: 2265 - RNA, 19 nt, Artificial Sequence
  siRNA Antisense Sequence
aagaaacgcuuuacccauc

SEQ ID NO: 2266 - RNA, 19 nt, Artificial Sequence
  siRNA Sense Sequence
auggguaaagcguuucuuc

SEQ ID NO: 2267 - RNA, 19 nt, Artificial Sequence
  siRNA Antisense Sequence
gaagaaacgcuuuacccau

SEQ ID NO: 2268 - RNA, 19 nt, Artificial Sequence
  siRNA Sense Sequence
uggguaaagcguuucuucu

SEQ ID NO: 2269 - RNA, 19 nt, Artificial Sequence
  siRNA Antisense Sequence
agaagaaacgcuuuaccca

SEQ ID NO: 2270 - RNA, 19 nt, Artificial Sequence
  siRNA Sense Sequence
ggguaaagcguuucuucua

SEQ ID NO: 2271 - RNA, 19 nt, Artificial Sequence
  siRNA Antisense Sequence
uagaagaaacgcuuuaccc

SEQ ID NO: 2272 - RNA, 19 nt, Artificial Sequence
  siRNA Sense Sequence
gguaaagcguuucuucuaa

SEQ ID NO: 2273 - RNA, 19 nt, Artificial Sequence
  siRNA Antisense Sequence
uuagaagaaacgcuuuacc

SEQ ID NO: 2274 - RNA, 19 nt, Artificial Sequence
  siRNA Sense Sequence
guaaagcguuucuucuaaa

SEQ ID NO: 2275 - RNA, 19 nt, Artificial Sequence
  siRNA Antisense Sequence
uuuagaagaaacgcuuuac

SEQ ID NO: 2276 - RNA, 19 nt, Artificial Sequence
  siRNA Sense Sequence
uaaagcguuucuucuaaag

SEQ ID NO: 2277 - RNA, 19 nt, Artificial Sequence
  siRNA Antisense Sequence
cuuuagaagaaacgcuuua

SEQ ID NO: 2278 - RNA, 19 nt, Artificial Sequence
  siRNA Sense Sequence
aaagcguuucuucuaaagg

SEQ ID NO: 2279 - RNA, 19 nt, Artificial Sequence
  siRNA Antisense Sequence
ccuuuagaagaaacgcuuu

SEQ ID NO: 2280 - RNA, 19 nt, Artificial Sequence
  siRNA Sense Sequence
aagcguuucuucuaaaggg

SEQ ID NO: 2281 - RNA, 19 nt, Artificial Sequence
  siRNA Antisense Sequence
cccuuuagaagaaacgcuu

SEQ ID NO: 2282 - RNA, 19 nt, Artificial Sequence
  siRNA Sense Sequence
aaagcaugauuuccugccc

SEQ ID NO: 2283 - RNA, 19 nt, Artificial Sequence
  siRNA Antisense Sequence
gggcaggaaaucaugcuuu

SEQ ID NO: 2284 - RNA, 19 nt, Artificial Sequence
  siRNA Sense Sequence
aagcaugauuuccugcccu

SEQ ID NO: 2285 - RNA, 19 nt, Artificial Sequence
  siRNA Antisense Sequence
agggcaggaaaucaugcuu

SEQ ID NO: 2286 - RNA, 19 nt, Artificial Sequence
  siRNA Sense Sequence
agcaugauuuccugcccua

SEQ ID NO: 2287 - RNA, 19 nt, Artificial Sequence
  siRNA Antisense Sequence
uagggcaggaaaucaugcu

SEQ ID NO: 2288 - RNA, 19 nt, Artificial Sequence
  siRNA Sense Sequence
gcaugauuuccugcccuaa

SEQ ID NO: 2289 - RNA, 19 nt, Artificial Sequence
  siRNA Antisense Sequence
uuagggcaggaaaucaugc

SEQ ID NO: 2290 - RNA, 19 nt, Artificial Sequence
  siRNA Sense Sequence
caugauuuccugcccuaag

SEQ ID NO: 2291 - RNA, 19 nt, Artificial Sequence
  siRNA Antisense Sequence
cuuagggcaggaaaucaug

SEQ ID NO: 2292 - RNA, 19 nt, Artificial Sequence
  siRNA Sense Sequence
augauuuccugcccuaagu

SEQ ID NO: 2293 - RNA, 19 nt, Artificial Sequence
  siRNA Antisense Sequence
acuuagggcaggaaaucau

SEQ ID NO: 2294 - RNA, 19 nt, Artificial Sequence
  siRNA Sense Sequence
ugauuuccugcccuaaguc

SEQ ID NO: 2295 - RNA, 19 nt, Artificial Sequence
  siRNA Antisense Sequence
gacuuagggcaggaaauca

SEQ ID NO: 2296 - RNA, 19 nt, Artificial Sequence
  siRNA Sense Sequence
gauuuccugcccuaagucc

SEQ ID NO: 2297 - RNA, 19 nt, Artificial Sequence
  siRNA Antisense Sequence
ggacuuagggcaggaaauc

SEQ ID NO: 2298 - RNA, 19 nt, Artificial Sequence
  siRNA Sense Sequence
auuuccugcccuaaguccu

SEQ ID NO: 2299 - RNA, 19 nt, Artificial Sequence
  siRNA Antisense Sequence
aggacuuagggcaggaaau

SEQ ID NO: 2300 - RNA, 19 nt, Artificial Sequence
  siRNA Sense Sequence
uuuccugcccuaaguccug

SEQ ID NO: 2301 - RNA, 19 nt, Artificial Sequence
  siRNA Antisense Sequence
caggacuuagggcaggaaa

SEQ ID NO: 2302 - RNA, 19 nt, Artificial Sequence
  siRNA Sense Sequence
uuccugcccuaaguccugu

SEQ ID NO: 2303 - RNA, 19 nt, Artificial Sequence
  siRNA Antisense Sequence
acaggacuuagggcaggaa

SEQ ID NO: 2304 - RNA, 19 nt, Artificial Sequence
  siRNA Sense Sequence
uccugcccuaaguccugug

SEQ ID NO: 2305 - RNA, 19 nt, Artificial Sequence
  siRNA Antisense Sequence
cacaggacuuagggcagga

SEQ ID NO: 2306 - RNA, 19 nt, Artificial Sequence
  siRNA Sense Sequence
agaagaugucagggacuag

SEQ ID NO: 2307 - RNA, 19 nt, Artificial Sequence
  siRNA Antisense Sequence
cuagucccugacaucuucu

SEQ ID NO: 2308 - RNA, 19 nt, Artificial Sequence
  siRNA Sense Sequence
gaagaugucagggacuagg

SEQ ID NO: 2309 - RNA, 19 nt, Artificial Sequence
  siRNA Antisense Sequence
ccuagucccugacaucuuc

SEQ ID NO: 2310 - RNA, 19 nt, Artificial Sequence
  siRNA Sense Sequence
aagaugucagggacuaggg

SEQ ID NO: 2311 - RNA, 19 nt, Artificial Sequence
  siRNA Antisense Sequence
cccuagucccugacaucuu

SEQ ID NO: 2312 - RNA, 19 nt, Artificial Sequence
  siRNA Sense Sequence
agaugucagggacuaggga

SEQ ID NO: 2313 - RNA, 19 nt, Artificial Sequence
  siRNA Antisense Sequence
ucccuagucccugacaucu

SEQ ID NO: 2314 - RNA, 19 nt, Artificial Sequence
  siRNA Sense Sequence
gucagggacuagggaggga

SEQ ID NO: 2315 - RNA, 19 nt, Artificial Sequence
  siRNA Antisense Sequence
ucccucccuagucccugac

SEQ ID NO: 2316 - RNA, 19 nt, Artificial Sequence
  siRNA Sense Sequence
uacuuagccucucccaaga

SEQ ID NO: 2317 - RNA, 19 nt, Artificial Sequence
  siRNA Antisense Sequence
ucuugggagaggcuaagua

SEQ ID NO: 2318 - RNA, 19 nt, Artificial Sequence
  siRNA Sense Sequence
aggaggaagcagauagaug

SEQ ID NO: 2319 - RNA, 19 nt, Artificial Sequence
  siRNA Antisense Sequence
caucuaucugcuuccuccu

SEQ ID NO: 2320 - RNA, 19 nt, Artificial Sequence
  siRNA Sense Sequence
ggaggaagcagauagaugg

SEQ ID NO: 2321 - RNA, 19 nt, Artificial Sequence
  siRNA Antisense Sequence
ccaucuaucugcuuccucc

SEQ ID NO: 2322 - RNA, 19 nt, Artificial Sequence
  siRNA Sense Sequence
gaggaagcagauagauggu

SEQ ID NO: 2323 - RNA, 19 nt, Artificial Sequence
  siRNA Antisense Sequence
accaucuaucugcuuccuc

SEQ ID NO: 2324 - RNA, 19 nt, Artificial Sequence
  siRNA Sense Sequence
aggaagcagauagaugguc

SEQ ID NO: 2325 - RNA, 19 nt, Artificial Sequence
  siRNA Antisense Sequence
gaccaucuaucugcuuccu

SEQ ID NO: 2326 - RNA, 19 nt, Artificial Sequence
  siRNA Sense Sequence
ggaagcagauagauggucc

SEQ ID NO: 2327 - RNA, 19 nt, Artificial Sequence
  siRNA Antisense Sequence
ggaccaucuaucugcuucc

SEQ ID NO: 2328 - RNA, 19 nt, Artificial Sequence
  siRNA Sense Sequence
gaagcagauagauggucca

SEQ ID NO: 2329 - RNA, 19 nt, Artificial Sequence
  siRNA Antisense Sequence
uggaccaucuaucugcuuc

SEQ ID NO: 2330 - RNA, 19 nt, Artificial Sequence
  siRNA Sense Sequence
uagaugguccagcaggcuu

SEQ ID NO: 2331 - RNA, 19 nt, Artificial Sequence
  siRNA Antisense Sequence
aagccugcuggaccaucua

SEQ ID NO: 2332 - RNA, 19 nt, Artificial Sequence
  siRNA Sense Sequence
agaugguccagcaggcuug

SEQ ID NO: 2333 - RNA, 19 nt, Artificial Sequence
  siRNA Antisense Sequence
caagccugcuggaccaucu

SEQ ID NO: 2334 - RNA, 19 nt, Artificial Sequence
  siRNA Sense Sequence
gaugguccagcaggcuuga

SEQ ID NO: 2335 - RNA, 19 nt, Artificial Sequence
  siRNA Antisense Sequence
ucaagccugcuggaccauc

SEQ ID NO: 2336 - RNA, 19 nt, Artificial Sequence
  siRNA Sense Sequence
augguccagcaggcuugaa

SEQ ID NO: 2337 - RNA, 19 nt, Artificial Sequence
  siRNA Antisense Sequence
uucaagccugcuggaccau

SEQ ID NO: 2338 - RNA, 19 nt, Artificial Sequence
  siRNA Sense Sequence
ugguccagcaggcuugaag

SEQ ID NO: 2339 - RNA, 19 nt, Artificial Sequence
  siRNA Antisense Sequence
cuucaagccugcuggacca

SEQ ID NO: 2340 - RNA, 19 nt, Artificial Sequence
  siRNA Sense Sequence
gguccagcaggcuugaagc

SEQ ID NO: 2341 - RNA, 19 nt, Artificial Sequence
  siRNA Antisense Sequence
gcuucaagccugcuggacc

SEQ ID NO: 2342 - RNA, 19 nt, Artificial Sequence
  siRNA Sense Sequence
guccagcaggcuugaagca

SEQ ID NO: 2343 - RNA, 19 nt, Artificial Sequence
  siRNA Antisense Sequence
ugcuucaagccugcuggac

SEQ ID NO: 2344 - RNA, 19 nt, Artificial Sequence
  siRNA Sense Sequence
uccagcaggcuugaagcag

SEQ ID NO: 2345 - RNA, 19 nt, Artificial Sequence
  siRNA Antisense Sequence
cugcuucaagccugcugga

SEQ ID NO: 2346 - RNA, 19 nt, Artificial Sequence
  siRNA Sense Sequence
cccaggguaagggcuguug

SEQ ID NO: 2347 - RNA, 19 nt, Artificial Sequence
  siRNA Antisense Sequence
caacagcccuuacccuggg

SEQ ID NO: 2348 - RNA, 19 nt, Artificial Sequence
  siRNA Sense Sequence
ggguaagggcuguugaggu

SEQ ID NO: 2349 - RNA, 19 nt, Artificial Sequence
  siRNA Antisense Sequence
accucaacagcccuuaccc

SEQ ID NO: 2350 - RNA, 19 nt, Artificial Sequence
  siRNA Sense Sequence
gguaagggcuguugaggua

SEQ ID NO: 2351 - RNA, 19 nt, Artificial Sequence
  siRNA Antisense Sequence
uaccucaacagcccuuacc

SEQ ID NO: 2352 - RNA, 19 nt, Artificial Sequence
  siRNA Sense Sequence
guaagggcuguugagguac

SEQ ID NO: 2353 - RNA, 19 nt, Artificial Sequence
  siRNA Antisense Sequence
guaccucaacagcccuuac

SEQ ID NO: 2354 - RNA, 19 nt, Artificial Sequence
  siRNA Sense Sequence
uaagggcuguugagguacc

SEQ ID NO: 2355 - RNA, 19 nt, Artificial Sequence
  siRNA Antisense Sequence
gguaccucaacagcccuua

SEQ ID NO: 2356 - RNA, 19 nt, Artificial Sequence
  siRNA Sense Sequence
aagggcuguugagguaccu

SEQ ID NO: 2357 - RNA, 19 nt, Artificial Sequence
  siRNA Antisense Sequence
agguaccucaacagcccuu

SEQ ID NO: 2358 - RNA, 19 nt, Artificial Sequence
  siRNA Sense Sequence
agggcuguugagguaccuu

SEQ ID NO: 2359 - RNA, 19 nt, Artificial Sequence
  siRNA Antisense Sequence
aagguaccucaacagcccu

SEQ ID NO: 2360 - RNA, 19 nt, Artificial Sequence
  siRNA Sense Sequence
gggcuguugagguaccuua

SEQ ID NO: 2361 - RNA, 19 nt, Artificial Sequence
  siRNA Antisense Sequence
uaagguaccucaacagccc

SEQ ID NO: 2362 - RNA, 19 nt, Artificial Sequence
  siRNA Sense Sequence
ggcuguugagguaccuuaa

SEQ ID NO: 2363 - RNA, 19 nt, Artificial Sequence
  siRNA Antisense Sequence
uuaagguaccucaacagcc

SEQ ID NO: 2364 - RNA, 19 nt, Artificial Sequence
  siRNA Sense Sequence
gcuguugagguaccuuaag

SEQ ID NO: 2365 - RNA, 19 nt, Artificial Sequence
  siRNA Antisense Sequence
cuuaagguaccucaacagc

SEQ ID NO: 2366 - RNA, 19 nt, Artificial Sequence
  siRNA Sense Sequence
cuguugagguaccuuaagg

SEQ ID NO: 2367 - RNA, 19 nt, Artificial Sequence
  siRNA Antisense Sequence
ccuuaagguaccucaacag

SEQ ID NO: 2368 - RNA, 19 nt, Artificial Sequence
  siRNA Sense Sequence
uguugagguaccuuaaggg

SEQ ID NO: 2369 - RNA, 19 nt, Artificial Sequence
  siRNA Antisense Sequence
cccuuaagguaccucaaca

SEQ ID NO: 2370 - RNA, 19 nt, Artificial Sequence
  siRNA Sense Sequence
uaagggaaggucaagaggg

SEQ ID NO: 2371 - RNA, 19 nt, Artificial Sequence
  siRNA Antisense Sequence
cccucuugaccuucccuua

SEQ ID NO: 2372 - RNA, 19 nt, Artificial Sequence
  siRNA Sense Sequence
aagggaaggucaagaggga

SEQ ID NO: 2373 - RNA, 19 nt, Artificial Sequence
  siRNA Antisense Sequence
ucccucuugaccuucccuu

SEQ ID NO: 2374 - RNA, 19 nt, Artificial Sequence
  siRNA Sense Sequence
cgcugagggaggaugcuua

SEQ ID NO: 2375 - RNA, 19 nt, Artificial Sequence
  siRNA Antisense Sequence
uaagcauccucccucagcg

SEQ ID NO: 2376 - RNA, 19 nt, Artificial Sequence
  siRNA Sense Sequence
ugagggaggaugcuuaggg

SEQ ID NO: 2377 - RNA, 19 nt, Artificial Sequence
  siRNA Antisense Sequence
cccuaagcauccucccuca

SEQ ID NO: 2378 - RNA, 19 nt, Artificial Sequence
  siRNA Sense Sequence
ggcacuaagccuaagaagu

SEQ ID NO: 2379 - RNA, 19 nt, Artificial Sequence
  siRNA Antisense Sequence
acuucuuaggcuuagugcc

SEQ ID NO: 2380 - RNA, 19 nt, Artificial Sequence
  siRNA Sense Sequence
gcacuaagccuaagaaguu

SEQ ID NO: 2381 - RNA, 19 nt, Artificial Sequence
  siRNA Antisense Sequence
aacuucuuaggcuuagugc

SEQ ID NO: 2382 - RNA, 19 nt, Artificial Sequence
  siRNA Sense Sequence
cacuaagccuaagaaguuc

SEQ ID NO: 2383 - RNA, 19 nt, Artificial Sequence
  siRNA Antisense Sequence
gaacuucuuaggcuuagug

SEQ ID NO: 2384 - RNA, 19 nt, Artificial Sequence
  siRNA Sense Sequence
acuaagccuaagaaguucc

SEQ ID NO: 2385 - RNA, 19 nt, Artificial Sequence
  siRNA Antisense Sequence
ggaacuucuuaggcuuagu

SEQ ID NO: 2386 - RNA, 19 nt, Artificial Sequence
  siRNA Sense Sequence
agaucgagucucgcucugu

SEQ ID NO: 2387 - RNA, 19 nt, Artificial Sequence
  siRNA Antisense Sequence
acagagcgagacucgaucu

SEQ ID NO: 2388 - RNA, 19 nt, Artificial Sequence
  siRNA Sense Sequence
gaucgagucucgcucuguc

SEQ ID NO: 2389 - RNA, 19 nt, Artificial Sequence
  siRNA Antisense Sequence
gacagagcgagacucgauc

SEQ ID NO: 2390 - RNA, 19 nt, Artificial Sequence
  siRNA Sense Sequence
aucgagucucgcucuguca

SEQ ID NO: 2391 - RNA, 19 nt, Artificial Sequence
  siRNA Antisense Sequence
ugacagagcgagacucgau

SEQ ID NO: 2392 - RNA, 19 nt, Artificial Sequence
  siRNA Sense Sequence
agucucgcucugucaccag

SEQ ID NO: 2393 - RNA, 19 nt, Artificial Sequence
  siRNA Antisense Sequence
cuggugacagagcgagacu

SEQ ID NO: 2394 - RNA, 19 nt, Artificial Sequence
  siRNA Sense Sequence
gucucgcucugucaccagg

SEQ ID NO: 2395 - RNA, 19 nt, Artificial Sequence
  siRNA Antisense Sequence
ccuggugacagagcgagac

SEQ ID NO: 2396 - RNA, 19 nt, Artificial Sequence
  siRNA Sense Sequence
ucucgcucugucaccaggc

SEQ ID NO: 2397 - RNA, 19 nt, Artificial Sequence
  siRNA Antisense Sequence
gccuggugacagagcgaga

SEQ ID NO: 2398 - RNA, 19 nt, Artificial Sequence
  siRNA Sense Sequence
cucgcucugucaccaggcu

SEQ ID NO: 2399 - RNA, 19 nt, Artificial Sequence
  siRNA Antisense Sequence
agccuggugacagagcgag

SEQ ID NO: 2400 - RNA, 19 nt, Artificial Sequence
  siRNA Sense Sequence
gucaccaggcuggagugca

SEQ ID NO: 2401 - RNA, 19 nt, Artificial Sequence
  siRNA Antisense Sequence
ugcacuccagccuggugac

SEQ ID NO: 2402 - RNA, 19 nt, Artificial Sequence
  siRNA Sense Sequence
ggcucacugcaaccuccgu

SEQ ID NO: 2403 - RNA, 19 nt, Artificial Sequence
  siRNA Antisense Sequence
acggagguugcagugagcc

SEQ ID NO: 2404 - RNA, 19 nt, Artificial Sequence
  siRNA Sense Sequence
gcucacugcaaccuccguc

SEQ ID NO: 2405 - RNA, 19 nt, Artificial Sequence
  siRNA Antisense Sequence
gacggagguugcagugagc

SEQ ID NO: 2406 - RNA, 19 nt, Artificial Sequence
  siRNA Sense Sequence
uccgucuccuggguucaag

SEQ ID NO: 2407 - RNA, 19 nt, Artificial Sequence
  siRNA Antisense Sequence
cuugaacccaggagacgga

SEQ ID NO: 2408 - RNA, 19 nt, Artificial Sequence
  siRNA Sense Sequence
ccgucuccuggguucaagu

SEQ ID NO: 2409 - RNA, 19 nt, Artificial Sequence
  siRNA Antisense Sequence
acuugaacccaggagacgg

SEQ ID NO: 2410 - RNA, 19 nt, Artificial Sequence
  siRNA Sense Sequence
cgucuccuggguucaagug

SEQ ID NO: 2411 - RNA, 19 nt, Artificial Sequence
  siRNA Antisense Sequence
cacuugaacccaggagacg

SEQ ID NO: 2412 - RNA, 19 nt, Artificial Sequence
  siRNA Sense Sequence
gucuccuggguucaaguga

SEQ ID NO: 2413 - RNA, 19 nt, Artificial Sequence
  siRNA Antisense Sequence
ucacuugaacccaggagac

SEQ ID NO: 2414 - RNA, 19 nt, Artificial Sequence
  siRNA Sense Sequence
uggguucaagugauucuuc

SEQ ID NO: 2415 - RNA, 19 nt, Artificial Sequence
  siRNA Antisense Sequence
gaagaaucacuugaaccca

SEQ ID NO: 2416 - RNA, 19 nt, Artificial Sequence
  siRNA Sense Sequence
ggguucaagugauucuucu

SEQ ID NO: 2417 - RNA, 19 nt, Artificial Sequence
  siRNA Antisense Sequence
agaagaaucacuugaaccc

SEQ ID NO: 2418 - RNA, 19 nt, Artificial Sequence
  siRNA Sense Sequence
gguucaagugauucuucug

SEQ ID NO: 2419 - RNA, 19 nt, Artificial Sequence
  siRNA Antisense Sequence
cagaagaaucacuugaacc

SEQ ID NO: 2420 - RNA, 19 nt, Artificial Sequence
  siRNA Sense Sequence
guucaagugauucuucugc

SEQ ID NO: 2421 - RNA, 19 nt, Artificial Sequence
  siRNA Antisense Sequence
gcagaagaaucacuugaac

SEQ ID NO: 2422 - RNA, 19 nt, Artificial Sequence
  siRNA Sense Sequence
uucaagugauucuucugcc

SEQ ID NO: 2423 - RNA, 19 nt, Artificial Sequence
  siRNA Antisense Sequence
ggcagaagaaucacuugaa

SEQ ID NO: 2424 - RNA, 19 nt, Artificial Sequence
  siRNA Sense Sequence
ucaagugauucuucugccu

SEQ ID NO: 2425 - RNA, 19 nt, Artificial Sequence
  siRNA Antisense Sequence
aggcagaagaaucacuuga

SEQ ID NO: 2426 - RNA, 19 nt, Artificial Sequence
  siRNA Sense Sequence
cgagcagcugggauuacag

SEQ ID NO: 2427 - RNA, 19 nt, Artificial Sequence
  siRNA Antisense Sequence
cuguaaucccagcugcucg

SEQ ID NO: 2428 - RNA, 19 nt, Artificial Sequence
  siRNA Sense Sequence
cagcugggauuacaggcgc

SEQ ID NO: 2429 - RNA, 19 nt, Artificial Sequence
  siRNA Antisense Sequence
gcgccuguaaucccagcug

SEQ ID NO: 2430 - RNA, 19 nt, Artificial Sequence
  siRNA Sense Sequence
acauguuggccaggauggu

SEQ ID NO: 2431 - RNA, 19 nt, Artificial Sequence
  siRNA Antisense Sequence
accauccuggccaacaugu

SEQ ID NO: 2432 - RNA, 19 nt, Artificial Sequence
  siRNA Sense Sequence
cauguuggccaggaugguc

SEQ ID NO: 2433 - RNA, 19 nt, Artificial Sequence
  siRNA Antisense Sequence
gaccauccuggccaacaug

SEQ ID NO: 2434 - RNA, 19 nt, Artificial Sequence
  siRNA Sense Sequence
auguuggccaggauggucu

SEQ ID NO: 2435 - RNA, 19 nt, Artificial Sequence
  siRNA Antisense Sequence
agaccauccuggccaacau

SEQ ID NO: 2436 - RNA, 19 nt, Artificial Sequence
  siRNA Sense Sequence
uguuggccaggauggucuc

SEQ ID NO: 2437 - RNA, 19 nt, Artificial Sequence
  siRNA Antisense Sequence
gagaccauccuggccaaca

SEQ ID NO: 2438 - RNA, 19 nt, Artificial Sequence
  siRNA Sense Sequence
guuggccaggauggucuca

SEQ ID NO: 2439 - RNA, 19 nt, Artificial Sequence
  siRNA Antisense Sequence
ugagaccauccuggccaac

SEQ ID NO: 2440 - RNA, 19 nt, Artificial Sequence
  siRNA Sense Sequence
uuggccaggauggucucaa

SEQ ID NO: 2441 - RNA, 19 nt, Artificial Sequence
  siRNA Antisense Sequence
uugagaccauccuggccaa

SEQ ID NO: 2442 - RNA, 19 nt, Artificial Sequence
  siRNA Sense Sequence
uggccaggauggucucaau

SEQ ID NO: 2443 - RNA, 19 nt, Artificial Sequence
  siRNA Antisense Sequence
auugagaccauccuggcca

SEQ ID NO: 2444 - RNA, 19 nt, Artificial Sequence
  siRNA Sense Sequence
ggccaggauggucucaauc

SEQ ID NO: 2445 - RNA, 19 nt, Artificial Sequence
  siRNA Antisense Sequence
gauugagaccauccuggcc

SEQ ID NO: 2446 - RNA, 19 nt, Artificial Sequence
  siRNA Sense Sequence
gccaggauggucucaaucu

SEQ ID NO: 2447 - RNA, 19 nt, Artificial Sequence
  siRNA Antisense Sequence
agauugagaccauccuggc

SEQ ID NO: 2448 - RNA, 19 nt, Artificial Sequence
  siRNA Sense Sequence
ccaggauggucucaaucuc

SEQ ID NO: 2449 - RNA, 19 nt, Artificial Sequence
  siRNA Antisense Sequence
gagauugagaccauccugg

SEQ ID NO: 2450 - RNA, 19 nt, Artificial Sequence
  siRNA Sense Sequence
caggauggucucaaucucu

SEQ ID NO: 2451 - RNA, 19 nt, Artificial Sequence
  siRNA Antisense Sequence
agagauugagaccauccug

SEQ ID NO: 2452 - RNA, 19 nt, Artificial Sequence
  siRNA Sense Sequence
aggauggucucaaucucuu

SEQ ID NO: 2453 - RNA, 19 nt, Artificial Sequence
  siRNA Antisense Sequence
aagagauugagaccauccu

SEQ ID NO: 2454 - RNA, 19 nt, Artificial Sequence
  siRNA Sense Sequence
auuauaggcgugagccacc

SEQ ID NO: 2455 - RNA, 19 nt, Artificial Sequence
  siRNA Antisense Sequence
gguggcucacgccuauaau

SEQ ID NO: 2456 - RNA, 19 nt, Artificial Sequence
  siRNA Sense Sequence
uuauaggcgugagccaccg

SEQ ID NO: 2457 - RNA, 19 nt, Artificial Sequence
  siRNA Antisense Sequence
cgguggcucacgccuauaa

SEQ ID NO: 2458 - RNA, 19 nt, Artificial Sequence
  siRNA Sense Sequence
uauaggcgugagccaccgc

SEQ ID NO: 2459 - RNA, 19 nt, Artificial Sequence
  siRNA Antisense Sequence
gcgguggcucacgccuaua

SEQ ID NO: 2460 - RNA, 19 nt, Artificial Sequence
  siRNA Sense Sequence
gcgccuggcuuauacuuuc

SEQ ID NO: 2461 - RNA, 19 nt, Artificial Sequence
  siRNA Antisense Sequence
gaaaguauaagccaggcgc

SEQ ID NO: 2462 - RNA, 19 nt, Artificial Sequence
  siRNA Sense Sequence
cgccuggcuuauacuuucu

SEQ ID NO: 2463 - RNA, 19 nt, Artificial Sequence
  siRNA Antisense Sequence
agaaaguauaagccaggcg

SEQ ID NO: 2464 - RNA, 19 nt, Artificial Sequence
  siRNA Sense Sequence
ccuggcuuauacuuucuua

SEQ ID NO: 2465 - RNA, 19 nt, Artificial Sequence
  siRNA Antisense Sequence
uaagaaaguauaagccagg

SEQ ID NO: 2466 - RNA, 19 nt, Artificial Sequence
  siRNA Sense Sequence
cuggcuuauacuuucuuaa

SEQ ID NO: 2467 - RNA, 19 nt, Artificial Sequence
  siRNA Antisense Sequence
uuaagaaaguauaagccag

SEQ ID NO: 2468 - RNA, 19 nt, Artificial Sequence
  siRNA Sense Sequence
caaaugugagucauaaaga

SEQ ID NO: 2469 - RNA, 19 nt, Artificial Sequence
  siRNA Antisense Sequence
ucuuuaugacucacauuug

SEQ ID NO: 2470 - RNA, 19 nt, Artificial Sequence
  siRNA Sense Sequence
aaugugagucauaaagaag

SEQ ID NO: 2471 - RNA, 19 nt, Artificial Sequence
  siRNA Antisense Sequence
cuucuuuaugacucacauu

SEQ ID NO: 2472 - RNA, 19 nt, Artificial Sequence
  siRNA Sense Sequence
ugagucauaaagaaggguu

SEQ ID NO: 2473 - RNA, 19 nt, Artificial Sequence
  siRNA Antisense Sequence
aacccuucuuuaugacuca

SEQ ID NO: 2474 - RNA, 19 nt, Artificial Sequence
  siRNA Sense Sequence
agucauaaagaaggguuag

SEQ ID NO: 2475 - RNA, 19 nt, Artificial Sequence
  siRNA Antisense Sequence
cuaacccuucuuuaugacu

SEQ ID NO: 2476 - RNA, 19 nt, Artificial Sequence
  siRNA Sense Sequence
gucauaaagaaggguuagg

SEQ ID NO: 2477 - RNA, 19 nt, Artificial Sequence
  siRNA Antisense Sequence
ccuaacccuucuuuaugac

SEQ ID NO: 2478 - RNA, 19 nt, Artificial Sequence
  siRNA Sense Sequence
ucauaaagaaggguuaggg

SEQ ID NO: 2479 - RNA, 19 nt, Artificial Sequence
  siRNA Antisense Sequence
cccuaacccuucuuuauga

SEQ ID NO: 2480 - RNA, 19 nt, Artificial Sequence
  siRNA Sense Sequence
cauaaagaaggguuagggu

SEQ ID NO: 2481 - RNA, 19 nt, Artificial Sequence
  siRNA Antisense Sequence
acccuaacccuucuuuaug

SEQ ID NO: 2482 - RNA, 19 nt, Artificial Sequence
  siRNA Sense Sequence
aagaaggguuagggugaug

SEQ ID NO: 2483 - RNA, 19 nt, Artificial Sequence
  siRNA Antisense Sequence
caucacccuaacccuucuu

SEQ ID NO: 2484 - RNA, 19 nt, Artificial Sequence
  siRNA Sense Sequence
agaaggguuagggugaugg

SEQ ID NO: 2485 - RNA, 19 nt, Artificial Sequence
  siRNA Antisense Sequence
ccaucacccuaacccuucu

SEQ ID NO: 2486 - RNA, 19 nt, Artificial Sequence
  siRNA Sense Sequence
gaaggguuagggugauggu

SEQ ID NO: 2487 - RNA, 19 nt, Artificial Sequence
  siRNA Antisense Sequence
accaucacccuaacccuuc

SEQ ID NO: 2488 - RNA, 19 nt, Artificial Sequence
  siRNA Sense Sequence
aaggguuagggugaugguc

SEQ ID NO: 2489 - RNA, 19 nt, Artificial Sequence
  siRNA Antisense Sequence
gaccaucacccuaacccuu

SEQ ID NO: 2490 - RNA, 19 nt, Artificial Sequence
  siRNA Sense Sequence
aggguuagggugauggucc

SEQ ID NO: 2491 - RNA, 19 nt, Artificial Sequence
  siRNA Antisense Sequence
ggaccaucacccuaacccu

SEQ ID NO: 2492 - RNA, 19 nt, Artificial Sequence
  siRNA Sense Sequence
ggguuagggugauggucca

SEQ ID NO: 2493 - RNA, 19 nt, Artificial Sequence
  siRNA Antisense Sequence
uggaccaucacccuaaccc

SEQ ID NO: 2494 - RNA, 19 nt, Artificial Sequence
  siRNA Sense Sequence
gggugaugguccagagcaa

SEQ ID NO: 2495 - RNA, 19 nt, Artificial Sequence
  siRNA Antisense Sequence
uugcucuggaccaucaccc

SEQ ID NO: 2496 - RNA, 19 nt, Artificial Sequence
  siRNA Sense Sequence
ggugaugguccagagcaac

SEQ ID NO: 2497 - RNA, 19 nt, Artificial Sequence
  siRNA Antisense Sequence
guugcucuggaccaucacc

SEQ ID NO: 2498 - RNA, 19 nt, Artificial Sequence
  siRNA Sense Sequence
acaguucuucaaguguacu

SEQ ID NO: 2499 - RNA, 19 nt, Artificial Sequence
  siRNA Antisense Sequence
aguacacuugaagaacugu

SEQ ID NO: 2500 - RNA, 19 nt, Artificial Sequence
  siRNA Sense Sequence
caguucuucaaguguacuc

SEQ ID NO: 2501 - RNA, 19 nt, Artificial Sequence
  siRNA Antisense Sequence
gaguacacuugaagaacug

SEQ ID NO: 2502 - RNA, 19 nt, Artificial Sequence
  siRNA Sense Sequence
aguucuucaaguguacucu

SEQ ID NO: 2503 - RNA, 19 nt, Artificial Sequence
  siRNA Antisense Sequence
agaguacacuugaagaacu

SEQ ID NO: 2504 - RNA, 19 nt, Artificial Sequence
  siRNA Sense Sequence
caaguguacucuguaggcu

SEQ ID NO: 2505 - RNA, 19 nt, Artificial Sequence
  siRNA Antisense Sequence
agccuacagaguacacuug

SEQ ID NO: 2506 - RNA, 19 nt, Artificial Sequence
  siRNA Sense Sequence
aaguguacucuguaggcuu

SEQ ID NO: 2507 - RNA, 19 nt, Artificial Sequence
  siRNA Antisense Sequence
aagccuacagaguacacuu

SEQ ID NO: 2508 - RNA, 19 nt, Artificial Sequence
  siRNA Sense Sequence
guguacucuguaggcuucu

SEQ ID NO: 2509 - RNA, 19 nt, Artificial Sequence
  siRNA Antisense Sequence
agaagccuacagaguacac

SEQ ID NO: 2510 - RNA, 19 nt, Artificial Sequence
  siRNA Sense Sequence
uguacucuguaggcuucug

SEQ ID NO: 2511 - RNA, 19 nt, Artificial Sequence
  siRNA Antisense Sequence
cagaagccuacagaguaca

SEQ ID NO: 2512 - RNA, 19 nt, Artificial Sequence
  siRNA Sense Sequence
guacucuguaggcuucugg

SEQ ID NO: 2513 - RNA, 19 nt, Artificial Sequence
  siRNA Antisense Sequence
ccagaagccuacagaguac

SEQ ID NO: 2514 - RNA, 19 nt, Artificial Sequence
  siRNA Sense Sequence
uacucuguaggcuucuggg

SEQ ID NO: 2515 - RNA, 19 nt, Artificial Sequence
  siRNA Antisense Sequence
cccagaagccuacagagua

SEQ ID NO: 2516 - RNA, 19 nt, Artificial Sequence
  siRNA Sense Sequence
guaggcuucugggaggucc

SEQ ID NO: 2517 - RNA, 19 nt, Artificial Sequence
  siRNA Antisense Sequence
ggaccucccagaagccuac

SEQ ID NO: 2518 - RNA, 19 nt, Artificial Sequence
  siRNA Sense Sequence
uaggcuucugggagguccc

SEQ ID NO: 2519 - RNA, 19 nt, Artificial Sequence
  siRNA Antisense Sequence
gggaccucccagaagccua

SEQ ID NO: 2520 - RNA, 19 nt, Artificial Sequence
  siRNA Sense Sequence
aggcuucugggaggucccu

SEQ ID NO: 2521 - RNA, 19 nt, Artificial Sequence
  siRNA Antisense Sequence
agggaccucccagaagccu

SEQ ID NO: 2522 - RNA, 19 nt, Artificial Sequence
  siRNA Sense Sequence
ggcuucugggaggucccuu

SEQ ID NO: 2523 - RNA, 19 nt, Artificial Sequence
  siRNA Antisense Sequence
aagggaccucccagaagcc

SEQ ID NO: 2524 - RNA, 19 nt, Artificial Sequence
  siRNA Sense Sequence
gcuucugggaggucccuuu

SEQ ID NO: 2525 - RNA, 19 nt, Artificial Sequence
  siRNA Antisense Sequence
aaagggaccucccagaagc

SEQ ID NO: 2526 - RNA, 19 nt, Artificial Sequence
  siRNA Sense Sequence
cuucugggaggucccuuuu

SEQ ID NO: 2527 - RNA, 19 nt, Artificial Sequence
  siRNA Antisense Sequence
aaaagggaccucccagaag

SEQ ID NO: 2528 - RNA, 19 nt, Artificial Sequence
  siRNA Sense Sequence
uucugggaggucccuuuuc

SEQ ID NO: 2529 - RNA, 19 nt, Artificial Sequence
  siRNA Antisense Sequence
gaaaagggaccucccagaa

SEQ ID NO: 2530 - RNA, 19 nt, Artificial Sequence
  siRNA Sense Sequence
ucugggaggucccuuuuca

SEQ ID NO: 2531 - RNA, 19 nt, Artificial Sequence
  siRNA Antisense Sequence
ugaaaagggaccucccaga

SEQ ID NO: 2532 - RNA, 19 nt, Artificial Sequence
  siRNA Sense Sequence
cauguuauuugccuuuuga

SEQ ID NO: 2533 - RNA, 19 nt, Artificial Sequence
  siRNA Antisense Sequence
ucaaaaggcaaauaacaug

SEQ ID NO: 2534 - RNA, 19 nt, Artificial Sequence
  siRNA Sense Sequence
auuugccuuuugaauucuc

SEQ ID NO: 2535 - RNA, 19 nt, Artificial Sequence
  siRNA Antisense Sequence
gagaauucaaaaggcaaau

SEQ ID NO: 2536 - RNA, 19 nt, Artificial Sequence
  siRNA Sense Sequence
uuugccuuuugaauucuca

SEQ ID NO: 2537 - RNA, 19 nt, Artificial Sequence
  siRNA Antisense Sequence
ugagaauucaaaaggcaaa

SEQ ID NO: 2538 - RNA, 19 nt, Artificial Sequence
  siRNA Sense Sequence
uugccuuuugaauucucau

SEQ ID NO: 2539 - RNA, 19 nt, Artificial Sequence
  siRNA Antisense Sequence
augagaauucaaaaggcaa

SEQ ID NO: 2540 - RNA, 19 nt, Artificial Sequence
  siRNA Sense Sequence
ugccuuuugaauucucauu

SEQ ID NO: 2541 - RNA, 19 nt, Artificial Sequence
  siRNA Antisense Sequence
aaugagaauucaaaaggca

SEQ ID NO: 2542 - RNA, 19 nt, Artificial Sequence
  siRNA Sense Sequence
gccuuuugaauucucauua

SEQ ID NO: 2543 - RNA, 19 nt, Artificial Sequence
  siRNA Antisense Sequence
uaaugagaauucaaaaggc

SEQ ID NO: 2544 - RNA, 19 nt, Artificial Sequence
  siRNA Sense Sequence
auuguauuguggaguuuuc

SEQ ID NO: 2545 - RNA, 19 nt, Artificial Sequence
  siRNA Antisense Sequence
gaaaacuccacaauacaau

SEQ ID NO: 2546 - RNA, 19 nt, Artificial Sequence
  siRNA Sense Sequence
uuguauuguggaguuuucc

SEQ ID NO: 2547 - RNA, 19 nt, Artificial Sequence
  siRNA Antisense Sequence
ggaaaacuccacaauacaa

SEQ ID NO: 2548 - RNA, 19 nt, Artificial Sequence
  siRNA Sense Sequence
aguuuuccagaggccgugu

SEQ ID NO: 2549 - RNA, 19 nt, Artificial Sequence
  siRNA Antisense Sequence
acacggccucuggaaaacu

SEQ ID NO: 2550 - RNA, 19 nt, Artificial Sequence
  siRNA Sense Sequence
guuuuccagaggccgugug

SEQ ID NO: 2551 - RNA, 19 nt, Artificial Sequence
  siRNA Antisense Sequence
cacacggccucuggaaaac

SEQ ID NO: 2552 - RNA, 19 nt, Artificial Sequence
  siRNA Sense Sequence
uuuuccagaggccguguga

SEQ ID NO: 2553 - RNA, 19 nt, Artificial Sequence
  siRNA Antisense Sequence
ucacacggccucuggaaaa

SEQ ID NO: 2554 - RNA, 19 nt, Artificial Sequence
  siRNA Sense Sequence
uuuccagaggccgugugac

SEQ ID NO: 2555 - RNA, 19 nt, Artificial Sequence
  siRNA Antisense Sequence
gucacacggccucuggaaa

SEQ ID NO: 2556 - RNA, 19 nt, Artificial Sequence
  siRNA Sense Sequence
uuccagaggccgugugaca

SEQ ID NO: 2557 - RNA, 19 nt, Artificial Sequence
  siRNA Antisense Sequence
ugucacacggccucuggaa

SEQ ID NO: 2558 - RNA, 19 nt, Artificial Sequence
  siRNA Sense Sequence
uccagaggccgugugacau

SEQ ID NO: 2559 - RNA, 19 nt, Artificial Sequence
  siRNA Antisense Sequence
augucacacggccucugga

SEQ ID NO: 2560 - RNA, 19 nt, Artificial Sequence
  siRNA Sense Sequence
ccagaggccgugugacaug

SEQ ID NO: 2561 - RNA, 19 nt, Artificial Sequence
  siRNA Antisense Sequence
caugucacacggccucugg

SEQ ID NO: 2562 - RNA, 19 nt, Artificial Sequence
  siRNA Sense Sequence
cagaggccgugugacaugu

SEQ ID NO: 2563 - RNA, 19 nt, Artificial Sequence
  siRNA Antisense Sequence
acaugucacacggccucug

SEQ ID NO: 2564 - RNA, 19 nt, Artificial Sequence
  siRNA Sense Sequence
agaggccgugugacaugug

SEQ ID NO: 2565 - RNA, 19 nt, Artificial Sequence
  siRNA Antisense Sequence
cacaugucacacggccucu

SEQ ID NO: 2566 - RNA, 19 nt, Artificial Sequence
  siRNA Sense Sequence
gccgugugacaugugauua

SEQ ID NO: 2567 - RNA, 19 nt, Artificial Sequence
  siRNA Antisense Sequence
uaaucacaugucacacggc

SEQ ID NO: 2568 - RNA, 19 nt, Artificial Sequence
  siRNA Sense Sequence
ccgugugacaugugauuac

SEQ ID NO: 2569 - RNA, 19 nt, Artificial Sequence
  siRNA Antisense Sequence
guaaucacaugucacacgg

SEQ ID NO: 2570 - RNA, 19 nt, Artificial Sequence
  siRNA Sense Sequence
cgugugacaugugauuaca

SEQ ID NO: 2571 - RNA, 19 nt, Artificial Sequence
  siRNA Antisense Sequence
uguaaucacaugucacacg

SEQ ID NO: 2572 - RNA, 19 nt, Artificial Sequence
  siRNA Sense Sequence
gauuacaucaucuuucuga

SEQ ID NO: 2573 - RNA, 19 nt, Artificial Sequence
  siRNA Antisense Sequence
ucagaaagaugauguaauc

SEQ ID NO: 2574 - RNA, 19 nt, Artificial Sequence
  siRNA Sense Sequence
auuacaucaucuuucugac

SEQ ID NO: 2575 - RNA, 19 nt, Artificial Sequence
  siRNA Antisense Sequence
gucagaaagaugauguaau

SEQ ID NO: 2576 - RNA, 19 nt, Artificial Sequence
  siRNA Sense Sequence
uuacaucaucuuucugaca

SEQ ID NO: 2577 - RNA, 19 nt, Artificial Sequence
  siRNA Antisense Sequence
ugucagaaagaugauguaa

SEQ ID NO: 2578 - RNA, 19 nt, Artificial Sequence
  siRNA Sense Sequence
uacaucaucuuucugacau

SEQ ID NO: 2579 - RNA, 19 nt, Artificial Sequence
  siRNA Antisense Sequence
augucagaaagaugaugua

SEQ ID NO: 2580 - RNA, 19 nt, Artificial Sequence
  siRNA Sense Sequence
aucuuucugacaucauugu

SEQ ID NO: 2581 - RNA, 19 nt, Artificial Sequence
  siRNA Antisense Sequence
acaaugaugucagaaagau

SEQ ID NO: 2582 - RNA, 19 nt, Artificial Sequence
  siRNA Sense Sequence
auuguuaauggaaugugug

SEQ ID NO: 2583 - RNA, 19 nt, Artificial Sequence
  siRNA Antisense Sequence
cacacauuccauuaacaau

SEQ ID NO: 2584 - RNA, 19 nt, Artificial Sequence
  siRNA Sense Sequence
aaagugacuaagaugcuaa

SEQ ID NO: 2585 - RNA, 19 nt, Artificial Sequence
  siRNA Antisense Sequence
uuagcaucuuagucacuuu

SEQ ID NO: 2586 - RNA, 19 nt, Artificial Sequence
  siRNA Sense Sequence
aagugacuaagaugcuaag

SEQ ID NO: 2587 - RNA, 19 nt, Artificial Sequence
  siRNA Antisense Sequence
cuuagcaucuuagucacuu

SEQ ID NO: 2588 - RNA, 19 nt, Artificial Sequence
  siRNA Sense Sequence
agugacuaagaugcuaaga

SEQ ID NO: 2589 - RNA, 19 nt, Artificial Sequence
  siRNA Antisense Sequence
ucuuagcaucuuagucacu

SEQ ID NO: 2590 - RNA, 19 nt, Artificial Sequence
  siRNA Sense Sequence
gugacuaagaugcuaagag

SEQ ID NO: 2591 - RNA, 19 nt, Artificial Sequence
  siRNA Antisense Sequence
cucuuagcaucuuagucac

SEQ ID NO: 2592 - RNA, 19 nt, Artificial Sequence
  siRNA Sense Sequence
ugacuaagaugcuaagagc

SEQ ID NO: 2593 - RNA, 19 nt, Artificial Sequence
  siRNA Antisense Sequence
gcucuuagcaucuuaguca

SEQ ID NO: 2594 - RNA, 19 nt, Artificial Sequence
  siRNA Sense Sequence
gacuaagaugcuaagagcg

SEQ ID NO: 2595 - RNA, 19 nt, Artificial Sequence
  siRNA Antisense Sequence
cgcucuuagcaucuuaguc

SEQ ID NO: 2596 - RNA, 19 nt, Artificial Sequence
  siRNA Sense Sequence
acuaagaugcuaagagcgu

SEQ ID NO: 2597 - RNA, 19 nt, Artificial Sequence
  siRNA Antisense Sequence
acgcucuuagcaucuuagu

SEQ ID NO: 2598 - RNA, 19 nt, Artificial Sequence
  siRNA Sense Sequence
cuaagaugcuaagagcgua

SEQ ID NO: 2599 - RNA, 19 nt, Artificial Sequence
  siRNA Antisense Sequence
uacgcucuuagcaucuuag

SEQ ID NO: 2600 - RNA, 19 nt, Artificial Sequence
  siRNA Sense Sequence
uaagaugcuaagagcguau

SEQ ID NO: 2601 - RNA, 19 nt, Artificial Sequence
  siRNA Antisense Sequence
auacgcucuuagcaucuua

SEQ ID NO: 2602 - RNA, 19 nt, Artificial Sequence
  siRNA Sense Sequence
aagaugcuaagagcguauu

SEQ ID NO: 2603 - RNA, 19 nt, Artificial Sequence
  siRNA Antisense Sequence
aauacgcucuuagcaucuu

SEQ ID NO: 2604 - RNA, 19 nt, Artificial Sequence
  siRNA Sense Sequence
agaugcuaagagcguauuu

SEQ ID NO: 2605 - RNA, 19 nt, Artificial Sequence
  siRNA Antisense Sequence
aaauacgcucuuagcaucu

SEQ ID NO: 2606 - RNA, 19 nt, Artificial Sequence
  siRNA Sense Sequence
gaugcuaagagcguauuua

SEQ ID NO: 2607 - RNA, 19 nt, Artificial Sequence
  siRNA Antisense Sequence
uaaauacgcucuuagcauc

SEQ ID NO: 2608 - RNA, 19 nt, Artificial Sequence
  siRNA Sense Sequence
augcuaagagcguauuuau

SEQ ID NO: 2609 - RNA, 19 nt, Artificial Sequence
  siRNA Antisense Sequence
auaaauacgcucuuagcau

SEQ ID NO: 2610 - RNA, 19 nt, Artificial Sequence
  siRNA Sense Sequence
uaagagcguauuuauagcu

SEQ ID NO: 2611 - RNA, 19 nt, Artificial Sequence
  siRNA Antisense Sequence
agcuauaaauacgcucuua

SEQ ID NO: 2612 - RNA, 19 nt, Artificial Sequence
  siRNA Sense Sequence
agagcguauuuauagcuga

SEQ ID NO: 2613 - RNA, 19 nt, Artificial Sequence
  siRNA Antisense Sequence
ucagcuauaaauacgcucu

SEQ ID NO: 2614 - RNA, 19 nt, Artificial Sequence
  siRNA Sense Sequence
gagcguauuuauagcugag

SEQ ID NO: 2615 - RNA, 19 nt, Artificial Sequence
  siRNA Antisense Sequence
cucagcuauaaauacgcuc

SEQ ID NO: 2616 - RNA, 19 nt, Artificial Sequence
  siRNA Sense Sequence
agcguauuuauagcugagc

SEQ ID NO: 2617 - RNA, 19 nt, Artificial Sequence
  siRNA Antisense Sequence
gcucagcuauaaauacgcu

SEQ ID NO: 2618 - RNA, 19 nt, Artificial Sequence
  siRNA Sense Sequence
gcguauuuauagcugagcu

SEQ ID NO: 2619 - RNA, 19 nt, Artificial Sequence
  siRNA Antisense Sequence
agcucagcuauaaauacgc

SEQ ID NO: 2620 - RNA, 19 nt, Artificial Sequence
  siRNA Sense Sequence
cguauuuauagcugagcuc

SEQ ID NO: 2621 - RNA, 19 nt, Artificial Sequence
  siRNA Antisense Sequence
gagcucagcuauaaauacg

SEQ ID NO: 2622 - RNA, 19 nt, Artificial Sequence
  siRNA Sense Sequence
guauuuauagcugagcucu

SEQ ID NO: 2623 - RNA, 19 nt, Artificial Sequence
  siRNA Antisense Sequence
agagcucagcuauaaauac

SEQ ID NO: 2624 - RNA, 19 nt, Artificial Sequence
  siRNA Sense Sequence
uauuuauagcugagcucug

SEQ ID NO: 2625 - RNA, 19 nt, Artificial Sequence
  siRNA Antisense Sequence
cagagcucagcuauaaaua

SEQ ID NO: 2626 - RNA, 19 nt, Artificial Sequence
  siRNA Sense Sequence
auuuauagcugagcucuga

SEQ ID NO: 2627 - RNA, 19 nt, Artificial Sequence
  siRNA Antisense Sequence
ucagagcucagcuauaaau

SEQ ID NO: 2628 - RNA, 19 nt, Artificial Sequence
  siRNA Sense Sequence
uuuauagcugagcucugac

SEQ ID NO: 2629 - RNA, 19 nt, Artificial Sequence
  siRNA Antisense Sequence
gucagagcucagcuauaaa

SEQ ID NO: 2630 - RNA, 19 nt, Artificial Sequence
  siRNA Sense Sequence
uuauagcugagcucugacg

SEQ ID NO: 2631 - RNA, 19 nt, Artificial Sequence
  siRNA Antisense Sequence
cgucagagcucagcuauaa

SEQ ID NO: 2632 - RNA, 19 nt, Artificial Sequence
  siRNA Sense Sequence
agcugagcucugacguaag

SEQ ID NO: 2633 - RNA, 19 nt, Artificial Sequence
  siRNA Antisense Sequence
cuuacgucagagcucagcu

SEQ ID NO: 2634 - RNA, 19 nt, Artificial Sequence
  siRNA Sense Sequence
gcugagcucugacguaagu

SEQ ID NO: 2635 - RNA, 19 nt, Artificial Sequence
  siRNA Antisense Sequence
acuuacgucagagcucagc

SEQ ID NO: 2636 - RNA, 19 nt, Artificial Sequence
  siRNA Sense Sequence
cugagcucugacguaagug

SEQ ID NO: 2637 - RNA, 19 nt, Artificial Sequence
  siRNA Antisense Sequence
cacuuacgucagagcucag

SEQ ID NO: 2638 - RNA, 19 nt, Artificial Sequence
  siRNA Sense Sequence
ugagcucugacguaagugu

SEQ ID NO: 2639 - RNA, 19 nt, Artificial Sequence
  siRNA Antisense Sequence
acacuuacgucagagcuca

SEQ ID NO: 2640 - RNA, 19 nt, Artificial Sequence
  siRNA Sense Sequence
gagcucugacguaaguguc

SEQ ID NO: 2641 - RNA, 19 nt, Artificial Sequence
  siRNA Antisense Sequence
gacacuuacgucagagcuc

SEQ ID NO: 2642 - RNA, 19 nt, Artificial Sequence
  siRNA Sense Sequence
aggccaggcacagcagcaa

SEQ ID NO: 2643 - RNA, 19 nt, Artificial Sequence
  siRNA Antisense Sequence
uugcugcugugccuggccu

SEQ ID NO: 2644 - RNA, 19 nt, Artificial Sequence
  siRNA Sense Sequence
cagcaagcgggugggaaga

SEQ ID NO: 2645 - RNA, 19 nt, Artificial Sequence
  siRNA Antisense Sequence
ucuucccacccgcuugcug

SEQ ID NO: 2646 - RNA, 19 nt, Artificial Sequence
  siRNA Sense Sequence
agcaagcgggugggaagag

SEQ ID NO: 2647 - RNA, 19 nt, Artificial Sequence
  siRNA Antisense Sequence
cucuucccacccgcuugcu

SEQ ID NO: 2648 - RNA, 19 nt, Artificial Sequence
  siRNA Sense Sequence
caagcgggugggaagagcu

SEQ ID NO: 2649 - RNA, 19 nt, Artificial Sequence
  siRNA Antisense Sequence
agcucuucccacccgcuug

SEQ ID NO: 2650 - RNA, 19 nt, Artificial Sequence
  siRNA Sense Sequence
gggcaucugacagugaggg

SEQ ID NO: 2651 - RNA, 19 nt, Artificial Sequence
  siRNA Antisense Sequence
cccucacugucagaugccc

SEQ ID NO: 2652 - RNA, 19 nt, Artificial Sequence
  siRNA Sense Sequence
ggcaucugacagugagggu

SEQ ID NO: 2653 - RNA, 19 nt, Artificial Sequence
  siRNA Antisense Sequence
acccucacugucagaugcc

SEQ ID NO: 2654 - RNA, 19 nt, Artificial Sequence
  siRNA Sense Sequence
gugacuccugcagccacuu

SEQ ID NO: 2655 - RNA, 19 nt, Artificial Sequence
  siRNA Antisense Sequence
aaguggcugcaggagucac

SEQ ID NO: 2656 - RNA, 19 nt, Artificial Sequence
  siRNA Sense Sequence
ugacuccugcagccacuuc

SEQ ID NO: 2657 - RNA, 19 nt, Artificial Sequence
  siRNA Antisense Sequence
gaaguggcugcaggaguca

SEQ ID NO: 2658 - RNA, 19 nt, Artificial Sequence
  siRNA Sense Sequence
acuccugcagccacuucuu

SEQ ID NO: 2659 - RNA, 19 nt, Artificial Sequence
  siRNA Antisense Sequence
aagaaguggcugcaggagu

SEQ ID NO: 2660 - RNA, 19 nt, Artificial Sequence
  siRNA Sense Sequence
cuccugcagccacuucuug

SEQ ID NO: 2661 - RNA, 19 nt, Artificial Sequence
  siRNA Antisense Sequence
caagaaguggcugcaggag

SEQ ID NO: 2662 - RNA, 19 nt, Artificial Sequence
  siRNA Sense Sequence
uccugcagccacuucuugu

SEQ ID NO: 2663 - RNA, 19 nt, Artificial Sequence
  siRNA Antisense Sequence
acaagaaguggcugcagga

SEQ ID NO: 2664 - RNA, 19 nt, Artificial Sequence
  siRNA Sense Sequence
ccugcagccacuucuuguc

SEQ ID NO: 2665 - RNA, 19 nt, Artificial Sequence
  siRNA Antisense Sequence
gacaagaaguggcugcagg

SEQ ID NO: 2666 - RNA, 19 nt, Artificial Sequence
  siRNA Sense Sequence
cugcagccacuucuuguca

SEQ ID NO: 2667 - RNA, 19 nt, Artificial Sequence
  siRNA Antisense Sequence
ugacaagaaguggcugcag

SEQ ID NO: 2668 - RNA, 19 nt, Artificial Sequence
  siRNA Sense Sequence
ugacugccuacugauacca

SEQ ID NO: 2669 - RNA, 19 nt, Artificial Sequence
  siRNA Antisense Sequence
ugguaucaguaggcaguca

SEQ ID NO: 2670 - RNA, 19 nt, Artificial Sequence
  siRNA Sense Sequence
gacugccuacugauaccaa

SEQ ID NO: 2671 - RNA, 19 nt, Artificial Sequence
  siRNA Antisense Sequence
uugguaucaguaggcaguc

SEQ ID NO: 2672 - RNA, 19 nt, Artificial Sequence
  siRNA Sense Sequence
acagguaagccgucugagg

SEQ ID NO: 2673 - RNA, 19 nt, Artificial Sequence
  siRNA Antisense Sequence
ccucagacggcuuaccugu

SEQ ID NO: 2674 - RNA, 19 nt, Artificial Sequence
  siRNA Sense Sequence
cagguaagccgucugaggc

SEQ ID NO: 2675 - RNA, 19 nt, Artificial Sequence
  siRNA Antisense Sequence
gccucagacggcuuaccug

SEQ ID NO: 2676 - RNA, 19 nt, Artificial Sequence
  siRNA Sense Sequence
agguaagccgucugaggca

SEQ ID NO: 2677 - RNA, 19 nt, Artificial Sequence
  siRNA Antisense Sequence
ugccucagacggcuuaccu

SEQ ID NO: 2678 - RNA, 19 nt, Artificial Sequence
  siRNA Sense Sequence
gguaagccgucugaggcac

SEQ ID NO: 2679 - RNA, 19 nt, Artificial Sequence
  siRNA Antisense Sequence
gugccucagacggcuuacc

SEQ ID NO: 2680 - RNA, 19 nt, Artificial Sequence
  siRNA Sense Sequence
guaagccgucugaggcacc

SEQ ID NO: 2681 - RNA, 19 nt, Artificial Sequence
  siRNA Antisense Sequence
ggugccucagacggcuuac

SEQ ID NO: 2682 - RNA, 19 nt, Artificial Sequence
  siRNA Sense Sequence
uaagccgucugaggcacca

SEQ ID NO: 2683 - RNA, 19 nt, Artificial Sequence
  siRNA Antisense Sequence
uggugccucagacggcuua

SEQ ID NO: 2684 - RNA, 19 nt, Artificial Sequence
  siRNA Sense Sequence
aagccgucugaggcaccac

SEQ ID NO: 2685 - RNA, 19 nt, Artificial Sequence
  siRNA Antisense Sequence
guggugccucagacggcuu

SEQ ID NO: 2686 - RNA, 19 nt, Artificial Sequence
  siRNA Sense Sequence
uagauaccuccacuuugcu

SEQ ID NO: 2687 - RNA, 19 nt, Artificial Sequence
  siRNA Antisense Sequence
agcaaaguggagguaucua

SEQ ID NO: 2688 - RNA, 19 nt, Artificial Sequence
  siRNA Sense Sequence
gauaccuccacuuugcuga

SEQ ID NO: 2689 - RNA, 19 nt, Artificial Sequence
  siRNA Antisense Sequence
ucagcaaaguggagguauc

SEQ ID NO: 2690 - RNA, 19 nt, Artificial Sequence
  siRNA Sense Sequence
auaccuccacuuugcugac

SEQ ID NO: 2691 - RNA, 19 nt, Artificial Sequence
  siRNA Antisense Sequence
gucagcaaaguggagguau

SEQ ID NO: 2692 - RNA, 19 nt, Artificial Sequence
  siRNA Sense Sequence
ccacuuugcugaccaaugu

SEQ ID NO: 2693 - RNA, 19 nt, Artificial Sequence
  siRNA Antisense Sequence
acauuggucagcaaagugg

SEQ ID NO: 2694 - RNA, 19 nt, Artificial Sequence
  siRNA Sense Sequence
uuugcugaccaauguucca

SEQ ID NO: 2695 - RNA, 19 nt, Artificial Sequence
  siRNA Antisense Sequence
uggaacauuggucagcaaa

SEQ ID NO: 2696 - RNA, 19 nt, Artificial Sequence
  siRNA Sense Sequence
uugcugaccaauguuccag

SEQ ID NO: 2697 - RNA, 19 nt, Artificial Sequence
  siRNA Antisense Sequence
cuggaacauuggucagcaa

SEQ ID NO: 2698 - RNA, 19 nt, Artificial Sequence
  siRNA Sense Sequence
ugcugaccaauguuccaga

SEQ ID NO: 2699 - RNA, 19 nt, Artificial Sequence
  siRNA Antisense Sequence
ucuggaacauuggucagca

SEQ ID NO: 2700 - RNA, 19 nt, Artificial Sequence
  siRNA Sense Sequence
gcugaccaauguuccagac

SEQ ID NO: 2701 - RNA, 19 nt, Artificial Sequence
  siRNA Antisense Sequence
gucuggaacauuggucagc

SEQ ID NO: 2702 - RNA, 19 nt, Artificial Sequence
  siRNA Sense Sequence
cugaccaauguuccagacc

SEQ ID NO: 2703 - RNA, 19 nt, Artificial Sequence
  siRNA Antisense Sequence
ggucuggaacauuggucag

SEQ ID NO: 2704 - RNA, 19 nt, Artificial Sequence
  siRNA Sense Sequence
ccaauguuccagacccgag

SEQ ID NO: 2705 - RNA, 19 nt, Artificial Sequence
  siRNA Antisense Sequence
cucgggucuggaacauugg

SEQ ID NO: 2706 - RNA, 19 nt, Artificial Sequence
  siRNA Sense Sequence
gguagagggcugucauuuc

SEQ ID NO: 2707 - RNA, 19 nt, Artificial Sequence
  siRNA Antisense Sequence
gaaaugacagcccucuacc

SEQ ID NO: 2708 - RNA, 19 nt, Artificial Sequence
  siRNA Sense Sequence
guagagggcugucauuucc

SEQ ID NO: 2709 - RNA, 19 nt, Artificial Sequence
  siRNA Antisense Sequence
ggaaaugacagcccucuac

SEQ ID NO: 2710 - RNA, 19 nt, Artificial Sequence
  siRNA Sense Sequence
ugucauuucccagcccaac

SEQ ID NO: 2711 - RNA, 19 nt, Artificial Sequence
  siRNA Antisense Sequence
guugggcugggaaaugaca

SEQ ID NO: 2712 - RNA, 19 nt, Artificial Sequence
  siRNA Sense Sequence
gaaugguugcugggagcug

SEQ ID NO: 2713 - RNA, 19 nt, Artificial Sequence
  siRNA Antisense Sequence
cagcucccagcaaccauuc

SEQ ID NO: 2714 - RNA, 19 nt, Artificial Sequence
  siRNA Sense Sequence
cuggacagagcucuugaau

SEQ ID NO: 2715 - RNA, 19 nt, Artificial Sequence
  siRNA Antisense Sequence
auucaagagcucuguccag

SEQ ID NO: 2716 - RNA, 19 nt, Artificial Sequence
  siRNA Sense Sequence
uggacagagcucuugaaug

SEQ ID NO: 2717 - RNA, 19 nt, Artificial Sequence
  siRNA Antisense Sequence
cauucaagagcucugucca

SEQ ID NO: 2718 - RNA, 19 nt, Artificial Sequence
  siRNA Sense Sequence
cagagcucuugaauguguu

SEQ ID NO: 2719 - RNA, 19 nt, Artificial Sequence
  siRNA Antisense Sequence
aacacauucaagagcucug

SEQ ID NO: 2720 - RNA, 19 nt, Artificial Sequence
  siRNA Sense Sequence
agagcucuugaauguguuu

SEQ ID NO: 2721 - RNA, 19 nt, Artificial Sequence
  siRNA Antisense Sequence
aaacacauucaagagcucu

SEQ ID NO: 2722 - RNA, 19 nt, Artificial Sequence
  siRNA Sense Sequence
auguguuucagagcuuggg

SEQ ID NO: 2723 - RNA, 19 nt, Artificial Sequence
  siRNA Antisense Sequence
cccaagcucugaaacacau

SEQ ID NO: 2724 - RNA, 19 nt, Artificial Sequence
  siRNA Sense Sequence
aaaugcaggguggacagga

SEQ ID NO: 2725 - RNA, 19 nt, Artificial Sequence
  siRNA Antisense Sequence
uccuguccacccugcauuu

SEQ ID NO: 2726 - RNA, 19 nt, Artificial Sequence
  siRNA Sense Sequence
aaugcaggguggacaggag

SEQ ID NO: 2727 - RNA, 19 nt, Artificial Sequence
  siRNA Antisense Sequence
cuccuguccacccugcauu

SEQ ID NO: 2728 - RNA, 19 nt, Artificial Sequence
  siRNA Sense Sequence
augcaggguggacaggagg

SEQ ID NO: 2729 - RNA, 19 nt, Artificial Sequence
  siRNA Antisense Sequence
ccuccuguccacccugcau

SEQ ID NO: 2730 - RNA, 19 nt, Artificial Sequence
  siRNA Sense Sequence
gguggacaggagggucuaa

SEQ ID NO: 2731 - RNA, 19 nt, Artificial Sequence
  siRNA Antisense Sequence
uuagacccuccuguccacc

SEQ ID NO: 2732 - RNA, 19 nt, Artificial Sequence
  siRNA Sense Sequence
guggacaggagggucuaau

SEQ ID NO: 2733 - RNA, 19 nt, Artificial Sequence
  siRNA Antisense Sequence
auuagacccuccuguccac

SEQ ID NO: 2734 - RNA, 19 nt, Artificial Sequence
  siRNA Sense Sequence
uggacaggagggucuaauc

SEQ ID NO: 2735 - RNA, 19 nt, Artificial Sequence
  siRNA Antisense Sequence
gauuagacccuccugucca

SEQ ID NO: 2736 - RNA, 19 nt, Artificial Sequence
  siRNA Sense Sequence
ggacaggagggucuaaucg

SEQ ID NO: 2737 - RNA, 19 nt, Artificial Sequence
  siRNA Antisense Sequence
cgauuagacccuccugucc

SEQ ID NO: 2738 - RNA, 19 nt, Artificial Sequence
  siRNA Sense Sequence
gacaggagggucuaaucgu

SEQ ID NO: 2739 - RNA, 19 nt, Artificial Sequence
  siRNA Antisense Sequence
acgauuagacccuccuguc

SEQ ID NO: 2740 - RNA, 19 nt, Artificial Sequence
  siRNA Sense Sequence
acaggagggucuaaucguc

SEQ ID NO: 2741 - RNA, 19 nt, Artificial Sequence
  siRNA Antisense Sequence
gacgauuagacccuccugu

SEQ ID NO: 2742 - RNA, 19 nt, Artificial Sequence
  siRNA Sense Sequence
caggagggucuaaucgucu

SEQ ID NO: 2743 - RNA, 19 nt, Artificial Sequence
  siRNA Antisense Sequence
agacgauuagacccuccug

SEQ ID NO: 2744 - RNA, 19 nt, Artificial Sequence
  siRNA Sense Sequence
aggagggucuaaucgucuc

SEQ ID NO: 2745 - RNA, 19 nt, Artificial Sequence
  siRNA Antisense Sequence
gagacgauuagacccuccu

SEQ ID NO: 2746 - RNA, 19 nt, Artificial Sequence
  siRNA Sense Sequence
ggagggucuaaucgucuca

SEQ ID NO: 2747 - RNA, 19 nt, Artificial Sequence
  siRNA Antisense Sequence
ugagacgauuagacccucc

SEQ ID NO: 2748 - RNA, 19 nt, Artificial Sequence
  siRNA Sense Sequence
gagggucuaaucgucucag

SEQ ID NO: 2749 - RNA, 19 nt, Artificial Sequence
  siRNA Antisense Sequence
cugagacgauuagacccuc

SEQ ID NO: 2750 - RNA, 19 nt, Artificial Sequence
  siRNA Sense Sequence
agggucuaaucgucucagu

SEQ ID NO: 2751 - RNA, 19 nt, Artificial Sequence
  siRNA Antisense Sequence
acugagacgauuagacccu

SEQ ID NO: 2752 - RNA, 19 nt, Artificial Sequence
  siRNA Sense Sequence
gggucuaaucgucucagug

SEQ ID NO: 2753 - RNA, 19 nt, Artificial Sequence
  siRNA Antisense Sequence
cacugagacgauuagaccc

SEQ ID NO: 2754 - RNA, 19 nt, Artificial Sequence
  siRNA Sense Sequence
ggucuaaucgucucagugc

SEQ ID NO: 2755 - RNA, 19 nt, Artificial Sequence
  siRNA Antisense Sequence
gcacugagacgauuagacc

SEQ ID NO: 2756 - RNA, 19 nt, Artificial Sequence
  siRNA Sense Sequence
cccaccaaagagugcccug

SEQ ID NO: 2757 - RNA, 19 nt, Artificial Sequence
  siRNA Antisense Sequence
cagggcacucuuugguggg

SEQ ID NO: 2758 - RNA, 19 nt, Artificial Sequence
  siRNA Sense Sequence
ccaccaaagagugcccuga

SEQ ID NO: 2759 - RNA, 19 nt, Artificial Sequence
  siRNA Antisense Sequence
ucagggcacucuuuggugg

SEQ ID NO: 2760 - RNA, 19 nt, Artificial Sequence
  siRNA Sense Sequence
ccaaagagugcccugaggu

SEQ ID NO: 2761 - RNA, 19 nt, Artificial Sequence
  siRNA Antisense Sequence
accucagggcacucuuugg

SEQ ID NO: 2762 - RNA, 19 nt, Artificial Sequence
  siRNA Sense Sequence
caaagagugcccugagguu

SEQ ID NO: 2763 - RNA, 19 nt, Artificial Sequence
  siRNA Antisense Sequence
aaccucagggcacucuuug

SEQ ID NO: 2764 - RNA, 19 nt, Artificial Sequence
  siRNA Sense Sequence
aaagagugcccugagguuc

SEQ ID NO: 2765 - RNA, 19 nt, Artificial Sequence
  siRNA Antisense Sequence
gaaccucagggcacucuuu

SEQ ID NO: 2766 - RNA, 19 nt, Artificial Sequence
  siRNA Sense Sequence
aagagugcccugagguucu

SEQ ID NO: 2767 - RNA, 19 nt, Artificial Sequence
  siRNA Antisense Sequence
agaaccucagggcacucuu

SEQ ID NO: 2768 - RNA, 19 nt, Artificial Sequence
  siRNA Sense Sequence
agagugcccugagguucua

SEQ ID NO: 2769 - RNA, 19 nt, Artificial Sequence
  siRNA Antisense Sequence
uagaaccucagggcacucu

SEQ ID NO: 2770 - RNA, 19 nt, Artificial Sequence
  siRNA Sense Sequence
gagugcccugagguucuag

SEQ ID NO: 2771 - RNA, 19 nt, Artificial Sequence
  siRNA Antisense Sequence
cuagaaccucagggcacuc

SEQ ID NO: 2772 - RNA, 19 nt, Artificial Sequence
  siRNA Sense Sequence
agugcccugagguucuagg

SEQ ID NO: 2773 - RNA, 19 nt, Artificial Sequence
  siRNA Antisense Sequence
ccuagaaccucagggcacu

SEQ ID NO: 2774 - RNA, 19 nt, Artificial Sequence
  siRNA Sense Sequence
gugcccugagguucuagga

SEQ ID NO: 2775 - RNA, 19 nt, Artificial Sequence
  siRNA Antisense Sequence
uccuagaaccucagggcac

SEQ ID NO: 2776 - RNA, 19 nt, Artificial Sequence
  siRNA Sense Sequence
ccugagguucuaggaagag

SEQ ID NO: 2777 - RNA, 19 nt, Artificial Sequence
  siRNA Antisense Sequence
cucuuccuagaaccucagg

SEQ ID NO: 2778 - RNA, 19 nt, Artificial Sequence
  siRNA Sense Sequence
cugagguucuaggaagagc

SEQ ID NO: 2779 - RNA, 19 nt, Artificial Sequence
  siRNA Antisense Sequence
gcucuuccuagaaccucag

SEQ ID NO: 2780 - RNA, 19 nt, Artificial Sequence
  siRNA Sense Sequence
uucuaggaagagccuggua

SEQ ID NO: 2781 - RNA, 19 nt, Artificial Sequence
  siRNA Antisense Sequence
uaccaggcucuuccuagaa

SEQ ID NO: 2782 - RNA, 19 nt, Artificial Sequence
  siRNA Sense Sequence
ucuaggaagagccugguac

SEQ ID NO: 2783 - RNA, 19 nt, Artificial Sequence
  siRNA Antisense Sequence
guaccaggcucuuccuaga

SEQ ID NO: 2784 - RNA, 19 nt, Artificial Sequence
  siRNA Sense Sequence
cuaggaagagccugguaca

SEQ ID NO: 2785 - RNA, 19 nt, Artificial Sequence
  siRNA Antisense Sequence
uguaccaggcucuuccuag

SEQ ID NO: 2786 - RNA, 19 nt, Artificial Sequence
  siRNA Sense Sequence
uaggaagagccugguacau

SEQ ID NO: 2787 - RNA, 19 nt, Artificial Sequence
  siRNA Antisense Sequence
auguaccaggcucuuccua

SEQ ID NO: 2788 - RNA, 19 nt, Artificial Sequence
  siRNA Sense Sequence
aggaagagccugguacauc

SEQ ID NO: 2789 - RNA, 19 nt, Artificial Sequence
  siRNA Antisense Sequence
gauguaccaggcucuuccu

SEQ ID NO: 2790 - RNA, 19 nt, Artificial Sequence
  siRNA Sense Sequence
ggaagagccugguacauca

SEQ ID NO: 2791 - RNA, 19 nt, Artificial Sequence
  siRNA Antisense Sequence
ugauguaccaggcucuucc

SEQ ID NO: 2792 - RNA, 19 nt, Artificial Sequence
  siRNA Sense Sequence
gaagagccugguacaucac

SEQ ID NO: 2793 - RNA, 19 nt, Artificial Sequence
  siRNA Antisense Sequence
gugauguaccaggcucuuc

SEQ ID NO: 2794 - RNA, 19 nt, Artificial Sequence
  siRNA Sense Sequence
aagagccugguacaucacc

SEQ ID NO: 2795 - RNA, 19 nt, Artificial Sequence
  siRNA Antisense Sequence
ggugauguaccaggcucuu

SEQ ID NO: 2796 - RNA, 19 nt, Artificial Sequence
  siRNA Sense Sequence
ucaccaagcuccauugcca

SEQ ID NO: 2797 - RNA, 19 nt, Artificial Sequence
  siRNA Antisense Sequence
uggcaauggagcuugguga

SEQ ID NO: 2798 - RNA, 19 nt, Artificial Sequence
  siRNA Sense Sequence
caccaagcuccauugccac

SEQ ID NO: 2799 - RNA, 19 nt, Artificial Sequence
  siRNA Antisense Sequence
guggcaauggagcuuggug

SEQ ID NO: 2800 - RNA, 19 nt, Artificial Sequence
  siRNA Sense Sequence
accaagcuccauugccacg

SEQ ID NO: 2801 - RNA, 19 nt, Artificial Sequence
  siRNA Antisense Sequence
cguggcaauggagcuuggu

SEQ ID NO: 2802 - RNA, 19 nt, Artificial Sequence
  siRNA Sense Sequence
ccaagcuccauugccacgu

SEQ ID NO: 2803 - RNA, 19 nt, Artificial Sequence
  siRNA Antisense Sequence
acguggcaauggagcuugg

SEQ ID NO: 2804 - RNA, 19 nt, Artificial Sequence
  siRNA Sense Sequence
caagcuccauugccacgug

SEQ ID NO: 2805 - RNA, 19 nt, Artificial Sequence
  siRNA Antisense Sequence
cacguggcaauggagcuug

SEQ ID NO: 2806 - RNA, 19 nt, Artificial Sequence
  siRNA Sense Sequence
aagcuccauugccacgugu

SEQ ID NO: 2807 - RNA, 19 nt, Artificial Sequence
  siRNA Antisense Sequence
acacguggcaauggagcuu

SEQ ID NO: 2808 - RNA, 19 nt, Artificial Sequence
  siRNA Sense Sequence
agcuccauugccacguguu

SEQ ID NO: 2809 - RNA, 19 nt, Artificial Sequence
  siRNA Antisense Sequence
aacacguggcaauggagcu

SEQ ID NO: 2810 - RNA, 19 nt, Artificial Sequence
  siRNA Sense Sequence
cuccauugccacguguuug

SEQ ID NO: 2811 - RNA, 19 nt, Artificial Sequence
  siRNA Antisense Sequence
caaacacguggcaauggag

SEQ ID NO: 2812 - RNA, 19 nt, Artificial Sequence
  siRNA Sense Sequence
uccauugccacguguuugu

SEQ ID NO: 2813 - RNA, 19 nt, Artificial Sequence
  siRNA Antisense Sequence
acaaacacguggcaaugga

SEQ ID NO: 2814 - RNA, 19 nt, Artificial Sequence
  siRNA Sense Sequence
ccauugccacguguuugug

SEQ ID NO: 2815 - RNA, 19 nt, Artificial Sequence
  siRNA Antisense Sequence
cacaaacacguggcaaugg

SEQ ID NO: 2816 - RNA, 19 nt, Artificial Sequence
  siRNA Sense Sequence
cauugccacguguuugugu

SEQ ID NO: 2817 - RNA, 19 nt, Artificial Sequence
  siRNA Antisense Sequence
acacaaacacguggcaaug

SEQ ID NO: 2818 - RNA, 19 nt, Artificial Sequence
  siRNA Sense Sequence
aaagguagcagugaugugg

SEQ ID NO: 2819 - RNA, 19 nt, Artificial Sequence
  siRNA Antisense Sequence
ccacaucacugcuaccuuu

SEQ ID NO: 2820 - RNA, 19 nt, Artificial Sequence
  siRNA Sense Sequence
aagguagcagugaugugga

SEQ ID NO: 2821 - RNA, 19 nt, Artificial Sequence
  siRNA Antisense Sequence
uccacaucacugcuaccuu

SEQ ID NO: 2822 - RNA, 19 nt, Artificial Sequence
  siRNA Sense Sequence
agguagcagugauguggau

SEQ ID NO: 2823 - RNA, 19 nt, Artificial Sequence
  siRNA Antisense Sequence
auccacaucacugcuaccu

SEQ ID NO: 2824 - RNA, 19 nt, Artificial Sequence
  siRNA Sense Sequence
gguagcagugauguggauc

SEQ ID NO: 2825 - RNA, 19 nt, Artificial Sequence
  siRNA Antisense Sequence
gauccacaucacugcuacc

SEQ ID NO: 2826 - RNA, 19 nt, Artificial Sequence
  siRNA Sense Sequence
guagcagugauguggaucc

SEQ ID NO: 2827 - RNA, 19 nt, Artificial Sequence
  siRNA Antisense Sequence
ggauccacaucacugcuac

SEQ ID NO: 2828 - RNA, 19 nt, Artificial Sequence
  siRNA Sense Sequence
uagcagugauguggauccu

SEQ ID NO: 2829 - RNA, 19 nt, Artificial Sequence
  siRNA Antisense Sequence
aggauccacaucacugcua

SEQ ID NO: 2830 - RNA, 19 nt, Artificial Sequence
  siRNA Sense Sequence
agcagugauguggauccug

SEQ ID NO: 2831 - RNA, 19 nt, Artificial Sequence
  siRNA Antisense Sequence
caggauccacaucacugcu

SEQ ID NO: 2832 - RNA, 19 nt, Artificial Sequence
  siRNA Sense Sequence
gcagugauguggauccuga

SEQ ID NO: 2833 - RNA, 19 nt, Artificial Sequence
  siRNA Antisense Sequence
ucaggauccacaucacugc

SEQ ID NO: 2834 - RNA, 19 nt, Artificial Sequence
  siRNA Sense Sequence
cagugauguggauccugaa

SEQ ID NO: 2835 - RNA, 19 nt, Artificial Sequence
  siRNA Antisense Sequence
uucaggauccacaucacug

SEQ ID NO: 2836 - RNA, 19 nt, Artificial Sequence
  siRNA Sense Sequence
agugauguggauccugaag

SEQ ID NO: 2837 - RNA, 19 nt, Artificial Sequence
  siRNA Antisense Sequence
cuucaggauccacaucacu

SEQ ID NO: 2838 - RNA, 19 nt, Artificial Sequence
  siRNA Sense Sequence
gugauguggauccugaaga

SEQ ID NO: 2839 - RNA, 19 nt, Artificial Sequence
  siRNA Antisense Sequence
ucuucaggauccacaucac

SEQ ID NO: 2840 - RNA, 19 nt, Artificial Sequence
  siRNA Sense Sequence
gauguggauccugaagaca

SEQ ID NO: 2841 - RNA, 19 nt, Artificial Sequence
  siRNA Antisense Sequence
ugucuucaggauccacauc

SEQ ID NO: 2842 - RNA, 19 nt, Artificial Sequence
  siRNA Sense Sequence
auguggauccugaagacag

SEQ ID NO: 2843 - RNA, 19 nt, Artificial Sequence
  siRNA Antisense Sequence
cugucuucaggauccacau

SEQ ID NO: 2844 - RNA, 19 nt, Artificial Sequence
  siRNA Sense Sequence
uguggauccugaagacagu

SEQ ID NO: 2845 - RNA, 19 nt, Artificial Sequence
  siRNA Antisense Sequence
acugucuucaggauccaca

SEQ ID NO: 2846 - RNA, 19 nt, Artificial Sequence
  siRNA Sense Sequence
guggauccugaagacaguc

SEQ ID NO: 2847 - RNA, 19 nt, Artificial Sequence
  siRNA Antisense Sequence
gacugucuucaggauccac

SEQ ID NO: 2848 - RNA, 19 nt, Artificial Sequence
  siRNA Sense Sequence
auccugaagacagucucuc

SEQ ID NO: 2849 - RNA, 19 nt, Artificial Sequence
  siRNA Antisense Sequence
gagagacugucuucaggau

SEQ ID NO: 2850 - RNA, 19 nt, Artificial Sequence
  siRNA Sense Sequence
uccugaagacagucucucu

SEQ ID NO: 2851 - RNA, 19 nt, Artificial Sequence
  siRNA Antisense Sequence
agagagacugucuucagga

SEQ ID NO: 2852 - RNA, 19 nt, Artificial Sequence
  siRNA Sense Sequence
agacagucucucuucucug

SEQ ID NO: 2853 - RNA, 19 nt, Artificial Sequence
  siRNA Antisense Sequence
cagagaagagagacugucu

SEQ ID NO: 2854 - RNA, 19 nt, Artificial Sequence
  siRNA Sense Sequence
agucucucuucucuggcag

SEQ ID NO: 2855 - RNA, 19 nt, Artificial Sequence
  siRNA Antisense Sequence
cugccagagaagagagacu

SEQ ID NO: 2856 - RNA, 19 nt, Artificial Sequence
  siRNA Sense Sequence
cucuucucuggcaguguga

SEQ ID NO: 2857 - RNA, 19 nt, Artificial Sequence
  siRNA Antisense Sequence
ucacacugccagagaagag

SEQ ID NO: 2858 - RNA, 19 nt, Artificial Sequence
  siRNA Sense Sequence
aaccagcuugucccugucu

SEQ ID NO: 2859 - RNA, 19 nt, Artificial Sequence
  siRNA Antisense Sequence
agacagggacaagcugguu

SEQ ID NO: 2860 - RNA, 19 nt, Artificial Sequence
  siRNA Sense Sequence
cagcuugucccugucucuu

SEQ ID NO: 2861 - RNA, 19 nt, Artificial Sequence
  siRNA Antisense Sequence
aagagacagggacaagcug

SEQ ID NO: 2862 - RNA, 19 nt, Artificial Sequence
  siRNA Sense Sequence
cagcugcuguccagaggca

SEQ ID NO: 2863 - RNA, 19 nt, Artificial Sequence
  siRNA Antisense Sequence
ugccucuggacagcagcug

SEQ ID NO: 2864 - RNA, 19 nt, Artificial Sequence
  siRNA Sense Sequence
cacggcacugccacauggu

SEQ ID NO: 2865 - RNA, 19 nt, Artificial Sequence
  siRNA Antisense Sequence
accauguggcagugccgug

SEQ ID NO: 2866 - RNA, 19 nt, Artificial Sequence
  siRNA Sense Sequence
acggcacugccacauggug

SEQ ID NO: 2867 - RNA, 19 nt, Artificial Sequence
  siRNA Antisense Sequence
caccauguggcagugccgu

SEQ ID NO: 2868 - RNA, 19 nt, Artificial Sequence
  siRNA Sense Sequence
augguggacacugguggua

SEQ ID NO: 2869 - RNA, 19 nt, Artificial Sequence
  siRNA Antisense Sequence
uaccaccaguguccaccau

SEQ ID NO: 2870 - RNA, 19 nt, Artificial Sequence
  siRNA Sense Sequence
ugguggacacuggugguac

SEQ ID NO: 2871 - RNA, 19 nt, Artificial Sequence
  siRNA Antisense Sequence
guaccaccaguguccacca

SEQ ID NO: 2872 - RNA, 19 nt, Artificial Sequence
  siRNA Sense Sequence
gguggacacuggugguacu

SEQ ID NO: 2873 - RNA, 19 nt, Artificial Sequence
  siRNA Antisense Sequence
aguaccaccaguguccacc

SEQ ID NO: 2874 - RNA, 19 nt, Artificial Sequence
  siRNA Sense Sequence
guggacacuggugguacug

SEQ ID NO: 2875 - RNA, 19 nt, Artificial Sequence
  siRNA Antisense Sequence
caguaccaccaguguccac

SEQ ID NO: 2876 - RNA, 19 nt, Artificial Sequence
  siRNA Sense Sequence
uggacacuggugguacuga

SEQ ID NO: 2877 - RNA, 19 nt, Artificial Sequence
  siRNA Antisense Sequence
ucaguaccaccagugucca

SEQ ID NO: 2878 - RNA, 19 nt, Artificial Sequence
  siRNA Sense Sequence
ggacacuggugguacugag

SEQ ID NO: 2879 - RNA, 19 nt, Artificial Sequence
  siRNA Antisense Sequence
cucaguaccaccagugucc

SEQ ID NO: 2880 - RNA, 19 nt, Artificial Sequence
  siRNA Sense Sequence
gacacuggugguacugagg

SEQ ID NO: 2881 - RNA, 19 nt, Artificial Sequence
  siRNA Antisense Sequence
ccucaguaccaccaguguc

SEQ ID NO: 2882 - RNA, 19 nt, Artificial Sequence
  siRNA Sense Sequence
acacuggugguacugaggu

SEQ ID NO: 2883 - RNA, 19 nt, Artificial Sequence
  siRNA Antisense Sequence
accucaguaccaccagugu

SEQ ID NO: 2884 - RNA, 19 nt, Artificial Sequence
  siRNA Sense Sequence
cacuggugguacugagguc

SEQ ID NO: 2885 - RNA, 19 nt, Artificial Sequence
  siRNA Antisense Sequence
gaccucaguaccaccagug

SEQ ID NO: 2886 - RNA, 19 nt, Artificial Sequence
  siRNA Sense Sequence
acuggugguacugaggucc

SEQ ID NO: 2887 - RNA, 19 nt, Artificial Sequence
  siRNA Antisense Sequence
ggaccucaguaccaccagu

SEQ ID NO: 2888 - RNA, 19 nt, Artificial Sequence
  siRNA Sense Sequence
cuggugguacugaggucca

SEQ ID NO: 2889 - RNA, 19 nt, Artificial Sequence
  siRNA Antisense Sequence
uggaccucaguaccaccag

SEQ ID NO: 2890 - RNA, 19 nt, Artificial Sequence
  siRNA Sense Sequence
uacugagguccagccuucc

SEQ ID NO: 2891 - RNA, 19 nt, Artificial Sequence
  siRNA Antisense Sequence
ggaaggcuggaccucagua

SEQ ID NO: 2892 - RNA, 19 nt, Artificial Sequence
  siRNA Sense Sequence
cugagguccagccuuccaa

SEQ ID NO: 2893 - RNA, 19 nt, Artificial Sequence
  siRNA Antisense Sequence
uuggaaggcuggaccucag

SEQ ID NO: 2894 - RNA, 19 nt, Artificial Sequence
  siRNA Sense Sequence
ugagguccagccuuccaau

SEQ ID NO: 2895 - RNA, 19 nt, Artificial Sequence
  siRNA Antisense Sequence
auuggaaggcuggaccuca

SEQ ID NO: 2896 - RNA, 19 nt, Artificial Sequence
  siRNA Sense Sequence
gagguccagccuuccaauu

SEQ ID NO: 2897 - RNA, 19 nt, Artificial Sequence
  siRNA Antisense Sequence
aauuggaaggcuggaccuc

SEQ ID NO: 2898 - RNA, 19 nt, Artificial Sequence
  siRNA Sense Sequence
agguccagccuuccaauua

SEQ ID NO: 2899 - RNA, 19 nt, Artificial Sequence
  siRNA Antisense Sequence
uaauuggaaggcuggaccu

SEQ ID NO: 2900 - RNA, 19 nt, Artificial Sequence
  siRNA Sense Sequence
gguccagccuuccaauuag

SEQ ID NO: 2901 - RNA, 19 nt, Artificial Sequence
  siRNA Antisense Sequence
cuaauuggaaggcuggacc

SEQ ID NO: 2902 - RNA, 19 nt, Artificial Sequence
  siRNA Sense Sequence
guccagccuuccaauuagg

SEQ ID NO: 2903 - RNA, 19 nt, Artificial Sequence
  siRNA Antisense Sequence
ccuaauuggaaggcuggac

SEQ ID NO: 2904 - RNA, 19 nt, Artificial Sequence
  siRNA Sense Sequence
uccagccuuccaauuagga

SEQ ID NO: 2905 - RNA, 19 nt, Artificial Sequence
  siRNA Antisense Sequence
uccuaauuggaaggcugga

SEQ ID NO: 2906 - RNA, 19 nt, Artificial Sequence
  siRNA Sense Sequence
gccuagaucuaauagucuc

SEQ ID NO: 2907 - RNA, 19 nt, Artificial Sequence
  siRNA Antisense Sequence
gagacuauuagaucuaggc

SEQ ID NO: 2908 - RNA, 19 nt, Artificial Sequence
  siRNA Sense Sequence
ccuagaucuaauagucucu

SEQ ID NO: 2909 - RNA, 19 nt, Artificial Sequence
  siRNA Antisense Sequence
agagacuauuagaucuagg

SEQ ID NO: 2910 - RNA, 19 nt, Artificial Sequence
  siRNA Sense Sequence
cuagaucuaauagucucuc

SEQ ID NO: 2911 - RNA, 19 nt, Artificial Sequence
  siRNA Antisense Sequence
gagagacuauuagaucuag

SEQ ID NO: 2912 - RNA, 19 nt, Artificial Sequence
  siRNA Sense Sequence
uagaucuaauagucucucu

SEQ ID NO: 2913 - RNA, 19 nt, Artificial Sequence
  siRNA Antisense Sequence
agagagacuauuagaucua

SEQ ID NO: 2914 - RNA, 19 nt, Artificial Sequence
  siRNA Sense Sequence
cuaauagucucucuugaca

SEQ ID NO: 2915 - RNA, 19 nt, Artificial Sequence
  siRNA Antisense Sequence
ugucaagagagacuauuag

SEQ ID NO: 2916 - RNA, 19 nt, Artificial Sequence
  siRNA Sense Sequence
uaauagucucucuugacag

SEQ ID NO: 2917 - RNA, 19 nt, Artificial Sequence
  siRNA Antisense Sequence
cugucaagagagacuauua

SEQ ID NO: 2918 - RNA, 19 nt, Artificial Sequence
  siRNA Sense Sequence
aauagucucucuugacagc

SEQ ID NO: 2919 - RNA, 19 nt, Artificial Sequence
  siRNA Antisense Sequence
gcugucaagagagacuauu

SEQ ID NO: 2920 - RNA, 19 nt, Artificial Sequence
  siRNA Sense Sequence
augagcaaaguggaguaaa

SEQ ID NO: 2921 - RNA, 19 nt, Artificial Sequence
  siRNA Antisense Sequence
uuuacuccacuuugcucau

SEQ ID NO: 2922 - RNA, 19 nt, Artificial Sequence
  siRNA Sense Sequence
ugagcaaaguggaguaaag

SEQ ID NO: 2923 - RNA, 19 nt, Artificial Sequence
  siRNA Antisense Sequence
cuuuacuccacuuugcuca

SEQ ID NO: 2924 - RNA, 19 nt, Artificial Sequence
  siRNA Sense Sequence
gagcaaaguggaguaaaga

SEQ ID NO: 2925 - RNA, 19 nt, Artificial Sequence
  siRNA Antisense Sequence
ucuuuacuccacuuugcuc

SEQ ID NO: 2926 - RNA, 19 nt, Artificial Sequence
  siRNA Sense Sequence
gcaaaguggaguaaagaca

SEQ ID NO: 2927 - RNA, 19 nt, Artificial Sequence
  siRNA Antisense Sequence
ugucuuuacuccacuuugc

SEQ ID NO: 2928 - RNA, 19 nt, Artificial Sequence
  siRNA Sense Sequence
caaaguggaguaaagacac

SEQ ID NO: 2929 - RNA, 19 nt, Artificial Sequence
  siRNA Antisense Sequence
gugucuuuacuccacuuug

SEQ ID NO: 2930 - RNA, 19 nt, Artificial Sequence
  siRNA Sense Sequence
auuuccaaaucacacccac

SEQ ID NO: 2931 - RNA, 19 nt, Artificial Sequence
  siRNA Antisense Sequence
gugggugugauuuggaaau

SEQ ID NO: 2932 - RNA, 19 nt, Artificial Sequence
  siRNA Sense Sequence
uccaaaucacacccacuuc

SEQ ID NO: 2933 - RNA, 19 nt, Artificial Sequence
  siRNA Antisense Sequence
gaagugggugugauuugga

SEQ ID NO: 2934 - RNA, 19 nt, Artificial Sequence
  siRNA Sense Sequence
ccaaaucacacccacuucc

SEQ ID NO: 2935 - RNA, 19 nt, Artificial Sequence
  siRNA Antisense Sequence
ggaagugggugugauuugg

SEQ ID NO: 2936 - RNA, 19 nt, Artificial Sequence
  siRNA Sense Sequence
aaaagcuagcaugaggccc

SEQ ID NO: 2937 - RNA, 19 nt, Artificial Sequence
  siRNA Antisense Sequence
gggccucaugcuagcuuuu

SEQ ID NO: 2938 - RNA, 19 nt, Artificial Sequence
  siRNA Sense Sequence
aaagcuagcaugaggccca

SEQ ID NO: 2939 - RNA, 19 nt, Artificial Sequence
  siRNA Antisense Sequence
ugggccucaugcuagcuuu

SEQ ID NO: 2940 - RNA, 19 nt, Artificial Sequence
  siRNA Sense Sequence
aagcuagcaugaggcccac

SEQ ID NO: 2941 - RNA, 19 nt, Artificial Sequence
  siRNA Antisense Sequence
gugggccucaugcuagcuu

SEQ ID NO: 2942 - RNA, 19 nt, Artificial Sequence
  siRNA Sense Sequence
cccaccuucaugaauucaa

SEQ ID NO: 2943 - RNA, 19 nt, Artificial Sequence
  siRNA Antisense Sequence
uugaauucaugaagguggg

SEQ ID NO: 2944 - RNA, 19 nt, Artificial Sequence
  siRNA Sense Sequence
accuucaugaauucaaugu

SEQ ID NO: 2945 - RNA, 19 nt, Artificial Sequence
  siRNA Antisense Sequence
acauugaauucaugaaggu

SEQ ID NO: 2946 - RNA, 19 nt, Artificial Sequence
  siRNA Sense Sequence
ccuucaugaauucaaugug

SEQ ID NO: 2947 - RNA, 19 nt, Artificial Sequence
  siRNA Antisense Sequence
cacauugaauucaugaagg

SEQ ID NO: 2948 - RNA, 19 nt, Artificial Sequence
  siRNA Sense Sequence
cuucaugaauucaaugugg

SEQ ID NO: 2949 - RNA, 19 nt, Artificial Sequence
  siRNA Antisense Sequence
ccacauugaauucaugaag

SEQ ID NO: 2950 - RNA, 19 nt, Artificial Sequence
  siRNA Sense Sequence
ucaugaauucaauguggag

SEQ ID NO: 2951 - RNA, 19 nt, Artificial Sequence
  siRNA Antisense Sequence
cuccacauugaauucauga

SEQ ID NO: 2952 - RNA, 19 nt, Artificial Sequence
  siRNA Sense Sequence
caugaauucaauguggagg

SEQ ID NO: 2953 - RNA, 19 nt, Artificial Sequence
  siRNA Antisense Sequence
ccuccacauugaauucaug

SEQ ID NO: 2954 - RNA, 19 nt, Artificial Sequence
  siRNA Sense Sequence
cauuuaaagccagugagga

SEQ ID NO: 2955 - RNA, 19 nt, Artificial Sequence
  siRNA Antisense Sequence
uccucacuggcuuuaaaug

SEQ ID NO: 2956 - RNA, 19 nt, Artificial Sequence
  siRNA Sense Sequence
uuuaaagccagugaggacu

SEQ ID NO: 2957 - RNA, 19 nt, Artificial Sequence
  siRNA Antisense Sequence
aguccucacuggcuuuaaa

SEQ ID NO: 2958 - RNA, 19 nt, Artificial Sequence
  siRNA Sense Sequence
aggacugggugugguggcu

SEQ ID NO: 2959 - RNA, 19 nt, Artificial Sequence
  siRNA Antisense Sequence
agccaccacacccaguccu

SEQ ID NO: 2960 - RNA, 19 nt, Artificial Sequence
  siRNA Sense Sequence
gacugggugugguggcuca

SEQ ID NO: 2961 - RNA, 19 nt, Artificial Sequence
  siRNA Antisense Sequence
ugagccaccacacccaguc

SEQ ID NO: 2962 - RNA, 19 nt, Artificial Sequence
  siRNA Sense Sequence
acugggugugguggcucau

SEQ ID NO: 2963 - RNA, 19 nt, Artificial Sequence
  siRNA Antisense Sequence
augagccaccacacccagu

SEQ ID NO: 2964 - RNA, 19 nt, Artificial Sequence
  siRNA Sense Sequence
cugggugugguggcucaug

SEQ ID NO: 2965 - RNA, 19 nt, Artificial Sequence
  siRNA Antisense Sequence
caugagccaccacacccag

SEQ ID NO: 2966 - RNA, 19 nt, Artificial Sequence
  siRNA Sense Sequence
ugggugugguggcucaugu

SEQ ID NO: 2967 - RNA, 19 nt, Artificial Sequence
  siRNA Antisense Sequence
acaugagccaccacaccca

SEQ ID NO: 2968 - RNA, 19 nt, Artificial Sequence
  siRNA Sense Sequence
gggugugguggcucauguc

SEQ ID NO: 2969 - RNA, 19 nt, Artificial Sequence
  siRNA Antisense Sequence
gacaugagccaccacaccc

SEQ ID NO: 2970 - RNA, 19 nt, Artificial Sequence
  siRNA Sense Sequence
ggugugguggcucaugucu

SEQ ID NO: 2971 - RNA, 19 nt, Artificial Sequence
  siRNA Antisense Sequence
agacaugagccaccacacc

SEQ ID NO: 2972 - RNA, 19 nt, Artificial Sequence
  siRNA Sense Sequence
gugugguggcucaugucua

SEQ ID NO: 2973 - RNA, 19 nt, Artificial Sequence
  siRNA Antisense Sequence
uagacaugagccaccacac

SEQ ID NO: 2974 - RNA, 19 nt, Artificial Sequence
  siRNA Sense Sequence
ugugguggcucaugucuau

SEQ ID NO: 2975 - RNA, 19 nt, Artificial Sequence
  siRNA Antisense Sequence
auagacaugagccaccaca

SEQ ID NO: 2976 - RNA, 19 nt, Artificial Sequence
  siRNA Sense Sequence
gaggaucgcuugagcccag

SEQ ID NO: 2977 - RNA, 19 nt, Artificial Sequence
  siRNA Antisense Sequence
cugggcucaagcgauccuc

SEQ ID NO: 2978 - RNA, 19 nt, Artificial Sequence
  siRNA Sense Sequence
aaauaaauuagccugugug

SEQ ID NO: 2979 - RNA, 19 nt, Artificial Sequence
  siRNA Antisense Sequence
cacacaggcuaauuuauuu

SEQ ID NO: 2980 - RNA, 19 nt, Artificial Sequence
  siRNA Sense Sequence
aauuagccuguguggugug

SEQ ID NO: 2981 - RNA, 19 nt, Artificial Sequence
  siRNA Antisense Sequence
cacaccacacaggcuaauu

SEQ ID NO: 2982 - RNA, 19 nt, Artificial Sequence
  siRNA Sense Sequence
auuagccuguguggugugg

SEQ ID NO: 2983 - RNA, 19 nt, Artificial Sequence
  siRNA Antisense Sequence
ccacaccacacaggcuaau

SEQ ID NO: 2984 - RNA, 19 nt, Artificial Sequence
  siRNA Sense Sequence
gccugugugguguggugug

SEQ ID NO: 2985 - RNA, 19 nt, Artificial Sequence
  siRNA Antisense Sequence
cacaccacaccacacaggc

SEQ ID NO: 2986 - RNA, 19 nt, Artificial Sequence
  siRNA Sense Sequence
ugugguguggugugguugg

SEQ ID NO: 2987 - RNA, 19 nt, Artificial Sequence
  siRNA Antisense Sequence
ccaaccacaccacaccaca

SEQ ID NO: 2988 - RNA, 19 nt, Artificial Sequence
  siRNA Sense Sequence
gguguggugugguuggugu

SEQ ID NO: 2989 - RNA, 19 nt, Artificial Sequence
  siRNA Antisense Sequence
acaccaaccacaccacacc

SEQ ID NO: 2990 - RNA, 19 nt, Artificial Sequence
  siRNA Sense Sequence
ugugguuggugugguggca

SEQ ID NO: 2991 - RNA, 19 nt, Artificial Sequence
  siRNA Antisense Sequence
ugccaccacaccaaccaca

SEQ ID NO: 2992 - RNA, 19 nt, Artificial Sequence
  siRNA Sense Sequence
gugguuggugugguggcac

SEQ ID NO: 2993 - RNA, 19 nt, Artificial Sequence
  siRNA Antisense Sequence
gugccaccacaccaaccac

SEQ ID NO: 2994 - RNA, 19 nt, Artificial Sequence
  siRNA Sense Sequence
ugguuggugugguggcacg

SEQ ID NO: 2995 - RNA, 19 nt, Artificial Sequence
  siRNA Antisense Sequence
cgugccaccacaccaacca

SEQ ID NO: 2996 - RNA, 19 nt, Artificial Sequence
  siRNA Sense Sequence
cacgcaccuguagacuuag

SEQ ID NO: 2997 - RNA, 19 nt, Artificial Sequence
  siRNA Antisense Sequence
cuaagucuacaggugcgug

SEQ ID NO: 2998 - RNA, 19 nt, Artificial Sequence
  siRNA Sense Sequence
acgcaccuguagacuuagc

SEQ ID NO: 2999 - RNA, 19 nt, Artificial Sequence
  siRNA Antisense Sequence
gcuaagucuacaggugcgu

SEQ ID NO: 3000 - RNA, 19 nt, Artificial Sequence
  siRNA Sense Sequence
agacuuagcuacucuggaa

SEQ ID NO: 3001 - RNA, 19 nt, Artificial Sequence
  siRNA Antisense Sequence
uuccagaguagcuaagucu

SEQ ID NO: 3002 - RNA, 19 nt, Artificial Sequence
  siRNA Sense Sequence
gacuuagcuacucuggaag

SEQ ID NO: 3003 - RNA, 19 nt, Artificial Sequence
  siRNA Antisense Sequence
cuuccagaguagcuaaguc

SEQ ID NO: 3004 - RNA, 19 nt, Artificial Sequence
  siRNA Sense Sequence
acuuagcuacucuggaagc

SEQ ID NO: 3005 - RNA, 19 nt, Artificial Sequence
  siRNA Antisense Sequence
gcuuccagaguagcuaagu

SEQ ID NO: 3006 - RNA, 19 nt, Artificial Sequence
  siRNA Sense Sequence
ggaagaaucacuuaaccca

SEQ ID NO: 3007 - RNA, 19 nt, Artificial Sequence
  siRNA Antisense Sequence
uggguuaagugauucuucc

SEQ ID NO: 3008 - RNA, 19 nt, Artificial Sequence
  siRNA Sense Sequence
ucacuuaacccaggagguc

SEQ ID NO: 3009 - RNA, 19 nt, Artificial Sequence
  siRNA Antisense Sequence
gaccuccuggguuaaguga

SEQ ID NO: 3010 - RNA, 19 nt, Artificial Sequence
  siRNA Sense Sequence
uuaacccaggaggucaagg

SEQ ID NO: 3011 - RNA, 19 nt, Artificial Sequence
  siRNA Antisense Sequence
ccuugaccuccuggguuaa

SEQ ID NO: 3012 - RNA, 19 nt, Artificial Sequence
  siRNA Sense Sequence
uaacccaggaggucaaggc

SEQ ID NO: 3013 - RNA, 19 nt, Artificial Sequence
  siRNA Antisense Sequence
gccuugaccuccuggguua

SEQ ID NO: 3014 - RNA, 19 nt, Artificial Sequence
  siRNA Sense Sequence
gucaaggcugcagugagcu

SEQ ID NO: 3015 - RNA, 19 nt, Artificial Sequence
  siRNA Antisense Sequence
agcucacugcagccuugac

SEQ ID NO: 3016 - RNA, 19 nt, Artificial Sequence
  siRNA Sense Sequence
ucaaggcugcagugagcug

SEQ ID NO: 3017 - RNA, 19 nt, Artificial Sequence
  siRNA Antisense Sequence
cagcucacugcagccuuga

SEQ ID NO: 3018 - RNA, 19 nt, Artificial Sequence
  siRNA Sense Sequence
caaggcugcagugagcugu

SEQ ID NO: 3019 - RNA, 19 nt, Artificial Sequence
  siRNA Antisense Sequence
acagcucacugcagccuug

SEQ ID NO: 3020 - RNA, 19 nt, Artificial Sequence
  siRNA Sense Sequence
aaggcugcagugagcugug

SEQ ID NO: 3021 - RNA, 19 nt, Artificial Sequence
  siRNA Antisense Sequence
cacagcucacugcagccuu

SEQ ID NO: 3022 - RNA, 19 nt, Artificial Sequence
  siRNA Sense Sequence
cugcagugagcugugauca

SEQ ID NO: 3023 - RNA, 19 nt, Artificial Sequence
  siRNA Antisense Sequence
ugaucacagcucacugcag

SEQ ID NO: 3024 - RNA, 19 nt, Artificial Sequence
  siRNA Sense Sequence
gucaggugcgguggcucau

SEQ ID NO: 3025 - RNA, 19 nt, Artificial Sequence
  siRNA Antisense Sequence
augagccaccgcaccugac

SEQ ID NO: 3026 - RNA, 19 nt, Artificial Sequence
  siRNA Sense Sequence
ucaggugcgguggcucaug

SEQ ID NO: 3027 - RNA, 19 nt, Artificial Sequence
  siRNA Antisense Sequence
caugagccaccgcaccuga

SEQ ID NO: 3028 - RNA, 19 nt, Artificial Sequence
  siRNA Sense Sequence
ugcgguggcucaugccugu

SEQ ID NO: 3029 - RNA, 19 nt, Artificial Sequence
  siRNA Antisense Sequence
acaggcaugagccaccgca

SEQ ID NO: 3030 - RNA, 19 nt, Artificial Sequence
  siRNA Sense Sequence
gcgguggcucaugccugua

SEQ ID NO: 3031 - RNA, 19 nt, Artificial Sequence
  siRNA Antisense Sequence
uacaggcaugagccaccgc

SEQ ID NO: 3032 - RNA, 19 nt, Artificial Sequence
  siRNA Sense Sequence
cgguggcucaugccuguaa

SEQ ID NO: 3033 - RNA, 19 nt, Artificial Sequence
  siRNA Antisense Sequence
uuacaggcaugagccaccg

SEQ ID NO: 3034 - RNA, 19 nt, Artificial Sequence
  siRNA Sense Sequence
gguggcucaugccuguaau

SEQ ID NO: 3035 - RNA, 19 nt, Artificial Sequence
  siRNA Antisense Sequence
auuacaggcaugagccacc

SEQ ID NO: 3036 - RNA, 19 nt, Artificial Sequence
  siRNA Sense Sequence
guggcucaugccuguaauc

SEQ ID NO: 3037 - RNA, 19 nt, Artificial Sequence
  siRNA Antisense Sequence
gauuacaggcaugagccac

SEQ ID NO: 3038 - RNA, 19 nt, Artificial Sequence
  siRNA Sense Sequence
uggcucaugccuguaaucc

SEQ ID NO: 3039 - RNA, 19 nt, Artificial Sequence
  siRNA Antisense Sequence
ggauuacaggcaugagcca

SEQ ID NO: 3040 - RNA, 19 nt, Artificial Sequence
  siRNA Sense Sequence
ggcucaugccuguaauccc

SEQ ID NO: 3041 - RNA, 19 nt, Artificial Sequence
  siRNA Antisense Sequence
gggauuacaggcaugagcc

SEQ ID NO: 3042 - RNA, 19 nt, Artificial Sequence
  siRNA Sense Sequence
augccuguaaucccagcac

SEQ ID NO: 3043 - RNA, 19 nt, Artificial Sequence
  siRNA Antisense Sequence
gugcugggauuacaggcau

SEQ ID NO: 3044 - RNA, 19 nt, Artificial Sequence
  siRNA Sense Sequence
cagcacuuugggaggccga

SEQ ID NO: 3045 - RNA, 19 nt, Artificial Sequence
  siRNA Antisense Sequence
ucggccucccaaagugcug

SEQ ID NO: 3046 - RNA, 19 nt, Artificial Sequence
  siRNA Sense Sequence
agcacuuugggaggccgag

SEQ ID NO: 3047 - RNA, 19 nt, Artificial Sequence
  siRNA Antisense Sequence
cucggccucccaaagugcu

SEQ ID NO: 3048 - RNA, 19 nt, Artificial Sequence
  siRNA Sense Sequence
gcaccuguagucccagcga

SEQ ID NO: 3049 - RNA, 19 nt, Artificial Sequence
  siRNA Antisense Sequence
ucgcugggacuacaggugc

SEQ ID NO: 3050 - RNA, 19 nt, Artificial Sequence
  siRNA Sense Sequence
caccuguagucccagcgac

SEQ ID NO: 3051 - RNA, 19 nt, Artificial Sequence
  siRNA Antisense Sequence
gucgcugggacuacaggug

SEQ ID NO: 3052 - RNA, 19 nt, Artificial Sequence
  siRNA Sense Sequence
ggaggcugaggcagaagaa

SEQ ID NO: 3053 - RNA, 19 nt, Artificial Sequence
  siRNA Antisense Sequence
uucuucugccucagccucc

SEQ ID NO: 3054 - RNA, 19 nt, Artificial Sequence
  siRNA Sense Sequence
gaggcugaggcagaagaau

SEQ ID NO: 3055 - RNA, 19 nt, Artificial Sequence
  siRNA Antisense Sequence
auucuucugccucagccuc

SEQ ID NO: 3056 - RNA, 19 nt, Artificial Sequence
  siRNA Sense Sequence
aggcugaggcagaagaaug

SEQ ID NO: 3057 - RNA, 19 nt, Artificial Sequence
  siRNA Antisense Sequence
cauucuucugccucagccu

SEQ ID NO: 3058 - RNA, 19 nt, Artificial Sequence
  siRNA Sense Sequence
ggcugaggcagaagaaugg

SEQ ID NO: 3059 - RNA, 19 nt, Artificial Sequence
  siRNA Antisense Sequence
ccauucuucugccucagcc

SEQ ID NO: 3060 - RNA, 19 nt, Artificial Sequence
  siRNA Sense Sequence
gcugaggcagaagaauggu

SEQ ID NO: 3061 - RNA, 19 nt, Artificial Sequence
  siRNA Antisense Sequence
accauucuucugccucagc

SEQ ID NO: 3062 - RNA, 19 nt, Artificial Sequence
  siRNA Sense Sequence
cugaggcagaagaauggug

SEQ ID NO: 3063 - RNA, 19 nt, Artificial Sequence
  siRNA Antisense Sequence
caccauucuucugccucag

SEQ ID NO: 3064 - RNA, 19 nt, Artificial Sequence
  siRNA Sense Sequence
ugaggcagaagaauggugu

SEQ ID NO: 3065 - RNA, 19 nt, Artificial Sequence
  siRNA Antisense Sequence
acaccauucuucugccuca

SEQ ID NO: 3066 - RNA, 19 nt, Artificial Sequence
  siRNA Sense Sequence
gagcuugcagugagccgag

SEQ ID NO: 3067 - RNA, 19 nt, Artificial Sequence
  siRNA Antisense Sequence
cucggcucacugcaagcuc

SEQ ID NO: 3068 - RNA, 19 nt, Artificial Sequence
  siRNA Sense Sequence
aaaauguggucaggagggc

SEQ ID NO: 3069 - RNA, 19 nt, Artificial Sequence
  siRNA Antisense Sequence
gcccuccugaccacauuuu

SEQ ID NO: 3070 - RNA, 19 nt, Artificial Sequence
  siRNA Sense Sequence
aaccaagacugcuguauuu

SEQ ID NO: 3071 - RNA, 19 nt, Artificial Sequence
  siRNA Antisense Sequence
aaauacagcagucuugguu

SEQ ID NO: 3072 - RNA, 19 nt, Artificial Sequence
  siRNA Sense Sequence
accaagacugcuguauuug

SEQ ID NO: 3073 - RNA, 19 nt, Artificial Sequence
  siRNA Antisense Sequence
caaauacagcagucuuggu

SEQ ID NO: 3074 - RNA, 19 nt, Artificial Sequence
  siRNA Sense Sequence
ccaagacugcuguauuugc

SEQ ID NO: 3075 - RNA, 19 nt, Artificial Sequence
  siRNA Antisense Sequence
gcaaauacagcagucuugg

SEQ ID NO: 3076 - RNA, 19 nt, Artificial Sequence
  siRNA Sense Sequence
caagacugcuguauuugcc

SEQ ID NO: 3077 - RNA, 19 nt, Artificial Sequence
  siRNA Antisense Sequence
ggcaaauacagcagucuug

SEQ ID NO: 3078 - RNA, 19 nt, Artificial Sequence
  siRNA Sense Sequence
aagacugcuguauuugccu

SEQ ID NO: 3079 - RNA, 19 nt, Artificial Sequence
  siRNA Antisense Sequence
aggcaaauacagcagucuu

SEQ ID NO: 3080 - RNA, 19 nt, Artificial Sequence
  siRNA Sense Sequence
gcuguauuugccuugcuuu

SEQ ID NO: 3081 - RNA, 19 nt, Artificial Sequence
  siRNA Antisense Sequence
aaagcaaggcaaauacagc

SEQ ID NO: 3082 - RNA, 19 nt, Artificial Sequence
  siRNA Sense Sequence
uugccuugcuuuguuguca

SEQ ID NO: 3083 - RNA, 19 nt, Artificial Sequence
  siRNA Antisense Sequence
ugacaacaaagcaaggcaa

SEQ ID NO: 3084 - RNA, 19 nt, Artificial Sequence
  siRNA Sense Sequence
ugccuugcuuuguugucaa

SEQ ID NO: 3085 - RNA, 19 nt, Artificial Sequence
  siRNA Antisense Sequence
uugacaacaaagcaaggca

SEQ ID NO: 3086 - RNA, 19 nt, Artificial Sequence
  siRNA Sense Sequence
uuguugucaaaagcucuua

SEQ ID NO: 3087 - RNA, 19 nt, Artificial Sequence
  siRNA Antisense Sequence
uaagagcuuuugacaacaa

SEQ ID NO: 3088 - RNA, 19 nt, Artificial Sequence
  siRNA Sense Sequence
uguugucaaaagcucuuag

SEQ ID NO: 3089 - RNA, 19 nt, Artificial Sequence
  siRNA Antisense Sequence
cuaagagcuuuugacaaca

SEQ ID NO: 3090 - RNA, 19 nt, Artificial Sequence
  siRNA Sense Sequence
guugucaaaagcucuuaga

SEQ ID NO: 3091 - RNA, 19 nt, Artificial Sequence
  siRNA Antisense Sequence
ucuaagagcuuuugacaac

SEQ ID NO: 3092 - RNA, 19 nt, Artificial Sequence
  siRNA Sense Sequence
uugucaaaagcucuuagag

SEQ ID NO: 3093 - RNA, 19 nt, Artificial Sequence
  siRNA Antisense Sequence
cucuaagagcuuuugacaa

SEQ ID NO: 3094 - RNA, 19 nt, Artificial Sequence
  siRNA Sense Sequence
ucuuagagcucccauuuuc

SEQ ID NO: 3095 - RNA, 19 nt, Artificial Sequence
  siRNA Antisense Sequence
gaaaaugggagcucuaaga

SEQ ID NO: 3096 - RNA, 19 nt, Artificial Sequence
  siRNA Sense Sequence
acuuuaggaggcugaggca

SEQ ID NO: 3097 - RNA, 19 nt, Artificial Sequence
  siRNA Antisense Sequence
ugccucagccuccuaaagu

SEQ ID NO: 3098 - RNA, 19 nt, Artificial Sequence
  siRNA Sense Sequence
cuuuaggaggcugaggcaa

SEQ ID NO: 3099 - RNA, 19 nt, Artificial Sequence
  siRNA Antisense Sequence
uugccucagccuccuaaag

SEQ ID NO: 3100 - RNA, 19 nt, Artificial Sequence
  siRNA Sense Sequence
uuuaggaggcugaggcaag

SEQ ID NO: 3101 - RNA, 19 nt, Artificial Sequence
  siRNA Antisense Sequence
cuugccucagccuccuaaa

SEQ ID NO: 3102 - RNA, 19 nt, Artificial Sequence
  siRNA Sense Sequence
uuaggaggcugaggcaagu

SEQ ID NO: 3103 - RNA, 19 nt, Artificial Sequence
  siRNA Antisense Sequence
acuugccucagccuccuaa

SEQ ID NO: 3104 - RNA, 19 nt, Artificial Sequence
  siRNA Sense Sequence
uaggaggcugaggcaagug

SEQ ID NO: 3105 - RNA, 19 nt, Artificial Sequence
  siRNA Antisense Sequence
cacuugccucagccuccua

SEQ ID NO: 3106 - RNA, 19 nt, Artificial Sequence
  siRNA Sense Sequence
aggaggcugaggcaagugg

SEQ ID NO: 3107 - RNA, 19 nt, Artificial Sequence
  siRNA Antisense Sequence
ccacuugccucagccuccu

SEQ ID NO: 3108 - RNA, 19 nt, Artificial Sequence
  siRNA Sense Sequence
ggaggcugaggcaagugga

SEQ ID NO: 3109 - RNA, 19 nt, Artificial Sequence
  siRNA Antisense Sequence
uccacuugccucagccucc

SEQ ID NO: 3110 - RNA, 19 nt, Artificial Sequence
  siRNA Sense Sequence
gaggcugaggcaaguggau

SEQ ID NO: 3111 - RNA, 19 nt, Artificial Sequence
  siRNA Antisense Sequence
auccacuugccucagccuc

SEQ ID NO: 3112 - RNA, 19 nt, Artificial Sequence
  siRNA Sense Sequence
guggauugcuugagcccag

SEQ ID NO: 3113 - RNA, 19 nt, Artificial Sequence
  siRNA Antisense Sequence
cugggcucaagcaauccac

SEQ ID NO: 3114 - RNA, 19 nt, Artificial Sequence
  siRNA Sense Sequence
uggauugcuugagcccagg

SEQ ID NO: 3115 - RNA, 19 nt, Artificial Sequence
  siRNA Antisense Sequence
ccugggcucaagcaaucca

SEQ ID NO: 3116 - RNA, 19 nt, Artificial Sequence
  siRNA Sense Sequence
ggauugcuugagcccagga

SEQ ID NO: 3117 - RNA, 19 nt, Artificial Sequence
  siRNA Antisense Sequence
uccugggcucaagcaaucc

SEQ ID NO: 3118 - RNA, 19 nt, Artificial Sequence
  siRNA Sense Sequence
gauugcuugagcccaggag

SEQ ID NO: 3119 - RNA, 19 nt, Artificial Sequence
  siRNA Antisense Sequence
cuccugggcucaagcaauc

SEQ ID NO: 3120 - RNA, 19 nt, Artificial Sequence
  siRNA Sense Sequence
auugcuugagcccaggagu

SEQ ID NO: 3121 - RNA, 19 nt, Artificial Sequence
  siRNA Antisense Sequence
acuccugggcucaagcaau

SEQ ID NO: 3122 - RNA, 19 nt, Artificial Sequence
  siRNA Sense Sequence
uugcuugagcccaggaguu

SEQ ID NO: 3123 - RNA, 19 nt, Artificial Sequence
  siRNA Antisense Sequence
aacuccugggcucaagcaa

SEQ ID NO: 3124 - RNA, 19 nt, Artificial Sequence
  siRNA Sense Sequence
ugcuugagcccaggaguuc

SEQ ID NO: 3125 - RNA, 19 nt, Artificial Sequence
  siRNA Antisense Sequence
gaacuccugggcucaagca

SEQ ID NO: 3126 - RNA, 19 nt, Artificial Sequence
  siRNA Sense Sequence
ugagcccaggaguucaaga

SEQ ID NO: 3127 - RNA, 19 nt, Artificial Sequence
  siRNA Antisense Sequence
ucuugaacuccugggcuca

SEQ ID NO: 3128 - RNA, 19 nt, Artificial Sequence
  siRNA Sense Sequence
auuagccaggugugguggu

SEQ ID NO: 3129 - RNA, 19 nt, Artificial Sequence
  siRNA Antisense Sequence
accaccacaccuggcuaau

SEQ ID NO: 3130 - RNA, 19 nt, Artificial Sequence
  siRNA Sense Sequence
uuagccaggugugguggug

SEQ ID NO: 3131 - RNA, 19 nt, Artificial Sequence
  siRNA Antisense Sequence
caccaccacaccuggcuaa

SEQ ID NO: 3132 - RNA, 19 nt, Artificial Sequence
  siRNA Sense Sequence
gugcgcaccuguaguccca

SEQ ID NO: 3133 - RNA, 19 nt, Artificial Sequence
  siRNA Antisense Sequence
ugggacuacaggugcgcac

SEQ ID NO: 3134 - RNA, 19 nt, Artificial Sequence
  siRNA Sense Sequence
ugcgcaccuguagucccaa

SEQ ID NO: 3135 - RNA, 19 nt, Artificial Sequence
  siRNA Antisense Sequence
uugggacuacaggugcgca

SEQ ID NO: 3136 - RNA, 19 nt, Artificial Sequence
  siRNA Sense Sequence
gcgcaccuguagucccaac

SEQ ID NO: 3137 - RNA, 19 nt, Artificial Sequence
  siRNA Antisense Sequence
guugggacuacaggugcgc

SEQ ID NO: 3138 - RNA, 19 nt, Artificial Sequence
  siRNA Sense Sequence
cgcaccuguagucccaacu

SEQ ID NO: 3139 - RNA, 19 nt, Artificial Sequence
  siRNA Antisense Sequence
aguugggacuacaggugcg

SEQ ID NO: 3140 - RNA, 19 nt, Artificial Sequence
  siRNA Sense Sequence
uacuaaggaggcugaggca

SEQ ID NO: 3141 - RNA, 19 nt, Artificial Sequence
  siRNA Antisense Sequence
ugccucagccuccuuagua

SEQ ID NO: 3142 - RNA, 19 nt, Artificial Sequence
  siRNA Sense Sequence
acuaaggaggcugaggcag

SEQ ID NO: 3143 - RNA, 19 nt, Artificial Sequence
  siRNA Antisense Sequence
cugccucagccuccuuagu

SEQ ID NO: 3144 - RNA, 19 nt, Artificial Sequence
  siRNA Sense Sequence
uucaaggcugcagugagcu

SEQ ID NO: 3145 - RNA, 19 nt, Artificial Sequence
  siRNA Antisense Sequence
agcucacugcagccuugaa

SEQ ID NO: 3146 - RNA, 19 nt, Artificial Sequence
  siRNA Sense Sequence
ucaaggcugcagugagcua

SEQ ID NO: 3147 - RNA, 19 nt, Artificial Sequence
  siRNA Antisense Sequence
uagcucacugcagccuuga

SEQ ID NO: 3148 - RNA, 19 nt, Artificial Sequence
  siRNA Sense Sequence
caaggcugcagugagcuau

SEQ ID NO: 3149 - RNA, 19 nt, Artificial Sequence
  siRNA Antisense Sequence
auagcucacugcagccuug

SEQ ID NO: 3150 - RNA, 19 nt, Artificial Sequence
  siRNA Sense Sequence
aaggcugcagugagcuaug

SEQ ID NO: 3151 - RNA, 19 nt, Artificial Sequence
  siRNA Antisense Sequence
cauagcucacugcagccuu

SEQ ID NO: 3152 - RNA, 19 nt, Artificial Sequence
  siRNA Sense Sequence
ugcagugagcuaugauugu

SEQ ID NO: 3153 - RNA, 19 nt, Artificial Sequence
  siRNA Antisense Sequence
acaaucauagcucacugca

SEQ ID NO: 3154 - RNA, 19 nt, Artificial Sequence
  siRNA Sense Sequence
gcagugagcuaugauugug

SEQ ID NO: 3155 - RNA, 19 nt, Artificial Sequence
  siRNA Antisense Sequence
cacaaucauagcucacugc

SEQ ID NO: 3156 - RNA, 19 nt, Artificial Sequence
  siRNA Sense Sequence
cagugagcuaugauugugc

SEQ ID NO: 3157 - RNA, 19 nt, Artificial Sequence
  siRNA Antisense Sequence
gcacaaucauagcucacug

SEQ ID NO: 3158 - RNA, 19 nt, Artificial Sequence
  siRNA Sense Sequence
ggaggccuggcacuacuuc

SEQ ID NO: 3159 - RNA, 19 nt, Artificial Sequence
  siRNA Antisense Sequence
gaaguagugccaggccucc

SEQ ID NO: 3160 - RNA, 19 nt, Artificial Sequence
  siRNA Sense Sequence
gaggccuggcacuacuucu

SEQ ID NO: 3161 - RNA, 19 nt, Artificial Sequence
  siRNA Antisense Sequence
agaaguagugccaggccuc

SEQ ID NO: 3162 - RNA, 19 nt, Artificial Sequence
  siRNA Sense Sequence
aggccuggcacuacuucua

SEQ ID NO: 3163 - RNA, 19 nt, Artificial Sequence
  siRNA Antisense Sequence
uagaaguagugccaggccu

SEQ ID NO: 3164 - RNA, 19 nt, Artificial Sequence
  siRNA Sense Sequence
ggccuggcacuacuucuag

SEQ ID NO: 3165 - RNA, 19 nt, Artificial Sequence
  siRNA Antisense Sequence
cuagaaguagugccaggcc

SEQ ID NO: 3166 - RNA, 19 nt, Artificial Sequence
  siRNA Sense Sequence
gccuggcacuacuucuagg

SEQ ID NO: 3167 - RNA, 19 nt, Artificial Sequence
  siRNA Antisense Sequence
ccuagaaguagugccaggc

SEQ ID NO: 3168 - RNA, 19 nt, Artificial Sequence
  siRNA Sense Sequence
ccuggcacuacuucuagga

SEQ ID NO: 3169 - RNA, 19 nt, Artificial Sequence
  siRNA Antisense Sequence
uccuagaaguagugccagg

SEQ ID NO: 3170 - RNA, 19 nt, Artificial Sequence
  siRNA Sense Sequence
cuggcacuacuucuaggau

SEQ ID NO: 3171 - RNA, 19 nt, Artificial Sequence
  siRNA Antisense Sequence
auccuagaaguagugccag

SEQ ID NO: 3172 - RNA, 19 nt, Artificial Sequence
  siRNA Sense Sequence
uggcacuacuucuaggaug

SEQ ID NO: 3173 - RNA, 19 nt, Artificial Sequence
  siRNA Antisense Sequence
cauccuagaaguagugcca

SEQ ID NO: 3174 - RNA, 19 nt, Artificial Sequence
  siRNA Sense Sequence
aauuuaggcaacucucaca

SEQ ID NO: 3175 - RNA, 19 nt, Artificial Sequence
  siRNA Antisense Sequence
ugugagaguugccuaaauu

SEQ ID NO: 3176 - RNA, 19 nt, Artificial Sequence
  siRNA Sense Sequence
auuuaggcaacucucacag

SEQ ID NO: 3177 - RNA, 19 nt, Artificial Sequence
  siRNA Antisense Sequence
cugugagaguugccuaaau

SEQ ID NO: 3178 - RNA, 19 nt, Artificial Sequence
  siRNA Sense Sequence
uuuaggcaacucucacagu

SEQ ID NO: 3179 - RNA, 19 nt, Artificial Sequence
  siRNA Antisense Sequence
acugugagaguugccuaaa

SEQ ID NO: 3180 - RNA, 19 nt, Artificial Sequence
  siRNA Sense Sequence
uuaggcaacucucacaguc

SEQ ID NO: 3181 - RNA, 19 nt, Artificial Sequence
  siRNA Antisense Sequence
gacugugagaguugccuaa

SEQ ID NO: 3182 - RNA, 19 nt, Artificial Sequence
  siRNA Sense Sequence
uaggcaacucucacagucc

SEQ ID NO: 3183 - RNA, 19 nt, Artificial Sequence
  siRNA Antisense Sequence
ggacugugagaguugccua

SEQ ID NO: 3184 - RNA, 19 nt, Artificial Sequence
  siRNA Sense Sequence
aggcaacucucacaguccc

SEQ ID NO: 3185 - RNA, 19 nt, Artificial Sequence
  siRNA Antisense Sequence
gggacugugagaguugccu

SEQ ID NO: 3186 - RNA, 19 nt, Artificial Sequence
  siRNA Sense Sequence
ggcaacucucacagucccu

SEQ ID NO: 3187 - RNA, 19 nt, Artificial Sequence
  siRNA Antisense Sequence
agggacugugagaguugcc

SEQ ID NO: 3188 - RNA, 19 nt, Artificial Sequence
  siRNA Sense Sequence
gcaacucucacagucccuu

SEQ ID NO: 3189 - RNA, 19 nt, Artificial Sequence
  siRNA Antisense Sequence
aagggacugugagaguugc

SEQ ID NO: 3190 - RNA, 19 nt, Artificial Sequence
  siRNA Sense Sequence
caacucucacagucccuug

SEQ ID NO: 3191 - RNA, 19 nt, Artificial Sequence
  siRNA Antisense Sequence
caagggacugugagaguug

SEQ ID NO: 3192 - RNA, 19 nt, Artificial Sequence
  siRNA Sense Sequence
aacucucacagucccuuga

SEQ ID NO: 3193 - RNA, 19 nt, Artificial Sequence
  siRNA Antisense Sequence
ucaagggacugugagaguu

SEQ ID NO: 3194 - RNA, 19 nt, Artificial Sequence
  siRNA Sense Sequence
acucucacagucccuugaa

SEQ ID NO: 3195 - RNA, 19 nt, Artificial Sequence
  siRNA Antisense Sequence
uucaagggacugugagagu

SEQ ID NO: 3196 - RNA, 19 nt, Artificial Sequence
  siRNA Sense Sequence
agaaguggcagcuggguau

SEQ ID NO: 3197 - RNA, 19 nt, Artificial Sequence
  siRNA Antisense Sequence
auacccagcugccacuucu

SEQ ID NO: 3198 - RNA, 19 nt, Artificial Sequence
  siRNA Sense Sequence
gaaguggcagcuggguaua

SEQ ID NO: 3199 - RNA, 19 nt, Artificial Sequence
  siRNA Antisense Sequence
uauacccagcugccacuuc

SEQ ID NO: 3200 - RNA, 19 nt, Artificial Sequence
  siRNA Sense Sequence
aaguggcagcuggguauag

SEQ ID NO: 3201 - RNA, 19 nt, Artificial Sequence
  siRNA Antisense Sequence
cuauacccagcugccacuu

SEQ ID NO: 3202 - RNA, 19 nt, Artificial Sequence
  siRNA Sense Sequence
aguggcagcuggguauagg

SEQ ID NO: 3203 - RNA, 19 nt, Artificial Sequence
  siRNA Antisense Sequence
ccuauacccagcugccacu

SEQ ID NO: 3204 - RNA, 19 nt, Artificial Sequence
  siRNA Sense Sequence
guggcagcuggguauaggc

SEQ ID NO: 3205 - RNA, 19 nt, Artificial Sequence
  siRNA Antisense Sequence
gccuauacccagcugccac

SEQ ID NO: 3206 - RNA, 19 nt, Artificial Sequence
  siRNA Sense Sequence
uggcagcuggguauaggcc

SEQ ID NO: 3207 - RNA, 19 nt, Artificial Sequence
  siRNA Antisense Sequence
ggccuauacccagcugcca

SEQ ID NO: 3208 - RNA, 19 nt, Artificial Sequence
  siRNA Sense Sequence
gcagcuggguauaggcccu

SEQ ID NO: 3209 - RNA, 19 nt, Artificial Sequence
  siRNA Antisense Sequence
agggccuauacccagcugc

SEQ ID NO: 3210 - RNA, 19 nt, Artificial Sequence
  siRNA Sense Sequence
cagcuggguauaggcccuc

SEQ ID NO: 3211 - RNA, 19 nt, Artificial Sequence
  siRNA Antisense Sequence
gagggccuauacccagcug

SEQ ID NO: 3212 - RNA, 19 nt, Artificial Sequence
  siRNA Sense Sequence
agcuggguauaggcccucc

SEQ ID NO: 3213 - RNA, 19 nt, Artificial Sequence
  siRNA Antisense Sequence
ggagggccuauacccagcu

SEQ ID NO: 3214 - RNA, 19 nt, Artificial Sequence
  siRNA Sense Sequence
gguauaggcccucccaagu

SEQ ID NO: 3215 - RNA, 19 nt, Artificial Sequence
  siRNA Antisense Sequence
acuugggagggccuauacc

SEQ ID NO: 3216 - RNA, 19 nt, Artificial Sequence
  siRNA Sense Sequence
guauaggcccucccaagug

SEQ ID NO: 3217 - RNA, 19 nt, Artificial Sequence
  siRNA Antisense Sequence
cacuugggagggccuauac

SEQ ID NO: 3218 - RNA, 19 nt, Artificial Sequence
  siRNA Sense Sequence
uauaggcccucccaagugu

SEQ ID NO: 3219 - RNA, 19 nt, Artificial Sequence
  siRNA Antisense Sequence
acacuugggagggccuaua

SEQ ID NO: 3220 - RNA, 19 nt, Artificial Sequence
  siRNA Sense Sequence
auaggcccucccaaguguc

SEQ ID NO: 3221 - RNA, 19 nt, Artificial Sequence
  siRNA Antisense Sequence
gacacuugggagggccuau

SEQ ID NO: 3222 - RNA, 19 nt, Artificial Sequence
  siRNA Sense Sequence
uaggcccucccaaguguca

SEQ ID NO: 3223 - RNA, 19 nt, Artificial Sequence
  siRNA Antisense Sequence
ugacacuugggagggccua

SEQ ID NO: 3224 - RNA, 19 nt, Artificial Sequence
  siRNA Sense Sequence
cccucccaagugucaugcc

SEQ ID NO: 3225 - RNA, 19 nt, Artificial Sequence
  siRNA Antisense Sequence
ggcaugacacuugggaggg

SEQ ID NO: 3226 - RNA, 19 nt, Artificial Sequence
  siRNA Sense Sequence
ccucccaagugucaugccc

SEQ ID NO: 3227 - RNA, 19 nt, Artificial Sequence
  siRNA Antisense Sequence
gggcaugacacuugggagg

SEQ ID NO: 3228 - RNA, 19 nt, Artificial Sequence
  siRNA Sense Sequence
cccugacaguccugaugga

SEQ ID NO: 3229 - RNA, 19 nt, Artificial Sequence
  siRNA Antisense Sequence
uccaucaggacugucaggg

SEQ ID NO: 3230 - RNA, 19 nt, Artificial Sequence
  siRNA Sense Sequence
cugauggacucugcccugu

SEQ ID NO: 3231 - RNA, 19 nt, Artificial Sequence
  siRNA Antisense Sequence
acagggcagaguccaucag

SEQ ID NO: 3232 - RNA, 19 nt, Artificial Sequence
  siRNA Sense Sequence
ugauggacucugcccugug

SEQ ID NO: 3233 - RNA, 19 nt, Artificial Sequence
  siRNA Antisense Sequence
cacagggcagaguccauca

SEQ ID NO: 3234 - RNA, 19 nt, Artificial Sequence
  siRNA Sense Sequence
uggacucugcccuguguaa

SEQ ID NO: 3235 - RNA, 19 nt, Artificial Sequence
  siRNA Antisense Sequence
uuacacagggcagagucca

SEQ ID NO: 3236 - RNA, 19 nt, Artificial Sequence
  siRNA Sense Sequence
ggacucugcccuguguaag

SEQ ID NO: 3237 - RNA, 19 nt, Artificial Sequence
  siRNA Antisense Sequence
cuuacacagggcagagucc

SEQ ID NO: 3238 - RNA, 19 nt, Artificial Sequence
  siRNA Sense Sequence
gacucugcccuguguaaga

SEQ ID NO: 3239 - RNA, 19 nt, Artificial Sequence
  siRNA Antisense Sequence
ucuuacacagggcagaguc

SEQ ID NO: 3240 - RNA, 19 nt, Artificial Sequence
  siRNA Sense Sequence
cugcccuguguaagauugc

SEQ ID NO: 3241 - RNA, 19 nt, Artificial Sequence
  siRNA Antisense Sequence
gcaaucuuacacagggcag

SEQ ID NO: 3242 - RNA, 19 nt, Artificial Sequence
  siRNA Sense Sequence
ugcccuguguaagauugca

SEQ ID NO: 3243 - RNA, 19 nt, Artificial Sequence
  siRNA Antisense Sequence
ugcaaucuuacacagggca

SEQ ID NO: 3244 - RNA, 19 nt, Artificial Sequence
  siRNA Sense Sequence
gcccuguguaagauugcau

SEQ ID NO: 3245 - RNA, 19 nt, Artificial Sequence
  siRNA Antisense Sequence
augcaaucuuacacagggc

SEQ ID NO: 3246 - RNA, 19 nt, Artificial Sequence
  siRNA Sense Sequence
cccuguguaagauugcauc

SEQ ID NO: 3247 - RNA, 19 nt, Artificial Sequence
  siRNA Antisense Sequence
gaugcaaucuuacacaggg

SEQ ID NO: 3248 - RNA, 19 nt, Artificial Sequence
  siRNA Sense Sequence
cuguguaagauugcaucac

SEQ ID NO: 3249 - RNA, 19 nt, Artificial Sequence
  siRNA Antisense Sequence
gugaugcaaucuuacacag

SEQ ID NO: 3250 - RNA, 19 nt, Artificial Sequence
  siRNA Sense Sequence
uguguaagauugcaucacc

SEQ ID NO: 3251 - RNA, 19 nt, Artificial Sequence
  siRNA Antisense Sequence
ggugaugcaaucuuacaca

SEQ ID NO: 3252 - RNA, 19 nt, Artificial Sequence
  siRNA Sense Sequence
guguaagauugcaucacca

SEQ ID NO: 3253 - RNA, 19 nt, Artificial Sequence
  siRNA Antisense Sequence
uggugaugcaaucuuacac

SEQ ID NO: 3254 - RNA, 19 nt, Artificial Sequence
  siRNA Sense Sequence
uguaagauugcaucaccac

SEQ ID NO: 3255 - RNA, 19 nt, Artificial Sequence
  siRNA Antisense Sequence
guggugaugcaaucuuaca

SEQ ID NO: 3256 - RNA, 19 nt, Artificial Sequence
  siRNA Sense Sequence
caccaccaccaccaccucu

SEQ ID NO: 3257 - RNA, 19 nt, Artificial Sequence
  siRNA Antisense Sequence
agaggugguggugguggug

SEQ ID NO: 3258 - RNA, 19 nt, Artificial Sequence
  siRNA Sense Sequence
accaccaccaccaccucuc

SEQ ID NO: 3259 - RNA, 19 nt, Artificial Sequence
  siRNA Antisense Sequence
gagaggugguggugguggu

SEQ ID NO: 3260 - RNA, 19 nt, Artificial Sequence
  siRNA Sense Sequence
ccaccaccaccaccucucu

SEQ ID NO: 3261 - RNA, 19 nt, Artificial Sequence
  siRNA Antisense Sequence
agagagguggugguggugg

SEQ ID NO: 3262 - RNA, 19 nt, Artificial Sequence
  siRNA Sense Sequence
caccaccaccaccucucug

SEQ ID NO: 3263 - RNA, 19 nt, Artificial Sequence
  siRNA Antisense Sequence
cagagagguggugguggug

SEQ ID NO: 3264 - RNA, 19 nt, Artificial Sequence
  siRNA Sense Sequence
accaccaccaccucucugg

SEQ ID NO: 3265 - RNA, 19 nt, Artificial Sequence
  siRNA Antisense Sequence
ccagagagguggugguggu

SEQ ID NO: 3266 - RNA, 19 nt, Artificial Sequence
  siRNA Sense Sequence
uggcccuccuccacaucau

SEQ ID NO: 3267 - RNA, 19 nt, Artificial Sequence
  siRNA Antisense Sequence
augauguggaggagggcca

SEQ ID NO: 3268 - RNA, 19 nt, Artificial Sequence
  siRNA Sense Sequence
ggcccuccuccacaucaug

SEQ ID NO: 3269 - RNA, 19 nt, Artificial Sequence
  siRNA Antisense Sequence
caugauguggaggagggcc

SEQ ID NO: 3270 - RNA, 19 nt, Artificial Sequence
  siRNA Sense Sequence
gcccuccuccacaucaugc

SEQ ID NO: 3271 - RNA, 19 nt, Artificial Sequence
  siRNA Antisense Sequence
gcaugauguggaggagggc

SEQ ID NO: 3272 - RNA, 19 nt, Artificial Sequence
  siRNA Sense Sequence
cccuccuccacaucaugcu

SEQ ID NO: 3273 - RNA, 19 nt, Artificial Sequence
  siRNA Antisense Sequence
agcaugauguggaggaggg

SEQ ID NO: 3274 - RNA, 19 nt, Artificial Sequence
  siRNA Sense Sequence
ccuccuccacaucaugcuc

SEQ ID NO: 3275 - RNA, 19 nt, Artificial Sequence
  siRNA Antisense Sequence
gagcaugauguggaggagg

SEQ ID NO: 3276 - RNA, 19 nt, Artificial Sequence
  siRNA Sense Sequence
cuccuccacaucaugcucc

SEQ ID NO: 3277 - RNA, 19 nt, Artificial Sequence
  siRNA Antisense Sequence
ggagcaugauguggaggag

SEQ ID NO: 3278 - RNA, 19 nt, Artificial Sequence
  siRNA Sense Sequence
uccuccacaucaugcucca

SEQ ID NO: 3279 - RNA, 19 nt, Artificial Sequence
  siRNA Antisense Sequence
uggagcaugauguggagga

SEQ ID NO: 3280 - RNA, 19 nt, Artificial Sequence
  siRNA Sense Sequence
ccuccacaucaugcuccac

SEQ ID NO: 3281 - RNA, 19 nt, Artificial Sequence
  siRNA Antisense Sequence
guggagcaugauguggagg

SEQ ID NO: 3282 - RNA, 19 nt, Artificial Sequence
  siRNA Sense Sequence
cuccacaucaugcuccaca

SEQ ID NO: 3283 - RNA, 19 nt, Artificial Sequence
  siRNA Antisense Sequence
uguggagcaugauguggag

SEQ ID NO: 3284 - RNA, 19 nt, Artificial Sequence
  siRNA Sense Sequence
acaucaugcuccacaucau

SEQ ID NO: 3285 - RNA, 19 nt, Artificial Sequence
  siRNA Antisense Sequence
augauguggagcaugaugu

SEQ ID NO: 3286 - RNA, 19 nt, Artificial Sequence
  siRNA Sense Sequence
augcuccacaucaugcucc

SEQ ID NO: 3287 - RNA, 19 nt, Artificial Sequence
  siRNA Antisense Sequence
ggagcaugauguggagcau

SEQ ID NO: 3288 - RNA, 19 nt, Artificial Sequence
  siRNA Sense Sequence
gcuccacaucaugcuccag

SEQ ID NO: 3289 - RNA, 19 nt, Artificial Sequence
  siRNA Antisense Sequence
cuggagcaugauguggagc

SEQ ID NO: 3290 - RNA, 19 nt, Artificial Sequence
  siRNA Sense Sequence
cuccacaucaugcuccagg

SEQ ID NO: 3291 - RNA, 19 nt, Artificial Sequence
  siRNA Antisense Sequence
ccuggagcaugauguggag

SEQ ID NO: 3292 - RNA, 19 nt, Artificial Sequence
  siRNA Sense Sequence
uccacaucaugcuccaggc

SEQ ID NO: 3293 - RNA, 19 nt, Artificial Sequence
  siRNA Antisense Sequence
gccuggagcaugaugugga

SEQ ID NO: 3294 - RNA, 19 nt, Artificial Sequence
  siRNA Sense Sequence
ccacaucaugcuccaggcc

SEQ ID NO: 3295 - RNA, 19 nt, Artificial Sequence
  siRNA Antisense Sequence
ggccuggagcaugaugugg

SEQ ID NO: 3296 - RNA, 19 nt, Artificial Sequence
  siRNA Sense Sequence
cacaucaugcuccaggcca

SEQ ID NO: 3297 - RNA, 19 nt, Artificial Sequence
  siRNA Antisense Sequence
uggccuggagcaugaugug

SEQ ID NO: 3298 - RNA, 19 nt, Artificial Sequence
  siRNA Sense Sequence
acaucaugcuccaggccaa

SEQ ID NO: 3299 - RNA, 19 nt, Artificial Sequence
  siRNA Antisense Sequence
uuggccuggagcaugaugu

SEQ ID NO: 3300 - RNA, 19 nt, Artificial Sequence
  siRNA Sense Sequence
caucaugcuccaggccaac

SEQ ID NO: 3301 - RNA, 19 nt, Artificial Sequence
  siRNA Antisense Sequence
guuggccuggagcaugaug

SEQ ID NO: 3302 - RNA, 19 nt, Artificial Sequence
  siRNA Sense Sequence
aucaugcuccaggccaacu

SEQ ID NO: 3303 - RNA, 19 nt, Artificial Sequence
  siRNA Antisense Sequence
aguuggccuggagcaugau

SEQ ID NO: 3304 - RNA, 19 nt, Artificial Sequence
  siRNA Sense Sequence
ucaugcuccaggccaacug

SEQ ID NO: 3305 - RNA, 19 nt, Artificial Sequence
  siRNA Antisense Sequence
caguuggccuggagcauga

SEQ ID NO: 3306 - RNA, 19 nt, Artificial Sequence
  siRNA Sense Sequence
gugacuucugugccucgug

SEQ ID NO: 3307 - RNA, 19 nt, Artificial Sequence
  siRNA Antisense Sequence
cacgaggcacagaagucac

SEQ ID NO: 3308 - RNA, 19 nt, Artificial Sequence
  siRNA Sense Sequence
ugacuucugugccucgugg

SEQ ID NO: 3309 - RNA, 19 nt, Artificial Sequence
  siRNA Antisense Sequence
ccacgaggcacagaaguca

SEQ ID NO: 3310 - RNA, 19 nt, Artificial Sequence
  siRNA Sense Sequence
gacuucugugccucguggc

SEQ ID NO: 3311 - RNA, 19 nt, Artificial Sequence
  siRNA Antisense Sequence
gccacgaggcacagaaguc

SEQ ID NO: 3312 - RNA, 19 nt, Artificial Sequence
  siRNA Sense Sequence
caccugggccugagcaaga

SEQ ID NO: 3313 - RNA, 19 nt, Artificial Sequence
  siRNA Antisense Sequence
ucuugcucaggcccaggug

SEQ ID NO: 3314 - RNA, 19 nt, Artificial Sequence
  siRNA Sense Sequence
accugggccugagcaagag

SEQ ID NO: 3315 - RNA, 19 nt, Artificial Sequence
  siRNA Antisense Sequence
cucuugcucaggcccaggu

SEQ ID NO: 3316 - RNA, 19 nt, Artificial Sequence
  siRNA Sense Sequence
agcaagagggcuccauucu

SEQ ID NO: 3317 - RNA, 19 nt, Artificial Sequence
  siRNA Antisense Sequence
agaauggagcccucuugcu

SEQ ID NO: 3318 - RNA, 19 nt, Artificial Sequence
  siRNA Sense Sequence
gcaagagggcuccauucuc

SEQ ID NO: 3319 - RNA, 19 nt, Artificial Sequence
  siRNA Antisense Sequence
gagaauggagcccucuugc

SEQ ID NO: 3320 - RNA, 19 nt, Artificial Sequence
  siRNA Sense Sequence
caagagggcuccauucucc

SEQ ID NO: 3321 - RNA, 19 nt, Artificial Sequence
  siRNA Antisense Sequence
ggagaauggagcccucuug

SEQ ID NO: 3322 - RNA, 19 nt, Artificial Sequence
  siRNA Sense Sequence
agagggcuccauucuccua

SEQ ID NO: 3323 - RNA, 19 nt, Artificial Sequence
  siRNA Antisense Sequence
uaggagaauggagcccucu

SEQ ID NO: 3324 - RNA, 19 nt, Artificial Sequence
  siRNA Sense Sequence
gagggcuccauucuccuac

SEQ ID NO: 3325 - RNA, 19 nt, Artificial Sequence
  siRNA Antisense Sequence
guaggagaauggagcccuc

SEQ ID NO: 3326 - RNA, 19 nt, Artificial Sequence
  siRNA Sense Sequence
agggcuccauucuccuacc

SEQ ID NO: 3327 - RNA, 19 nt, Artificial Sequence
  siRNA Antisense Sequence
gguaggagaauggagcccu

SEQ ID NO: 3328 - RNA, 19 nt, Artificial Sequence
  siRNA Sense Sequence
gggcuccauucuccuaccc

SEQ ID NO: 3329 - RNA, 19 nt, Artificial Sequence
  siRNA Antisense Sequence
ggguaggagaauggagccc

SEQ ID NO: 3330 - RNA, 19 nt, Artificial Sequence
  siRNA Sense Sequence
aacccucaucccuguccua

SEQ ID NO: 3331 - RNA, 19 nt, Artificial Sequence
  siRNA Antisense Sequence
uaggacagggaugaggguu

SEQ ID NO: 3332 - RNA, 19 nt, Artificial Sequence
  siRNA Sense Sequence
acccucaucccuguccuag

SEQ ID NO: 3333 - RNA, 19 nt, Artificial Sequence
  siRNA Antisense Sequence
cuaggacagggaugagggu

SEQ ID NO: 3334 - RNA, 19 nt, Artificial Sequence
  siRNA Sense Sequence
cccucaucccuguccuagc

SEQ ID NO: 3335 - RNA, 19 nt, Artificial Sequence
  siRNA Antisense Sequence
gcuaggacagggaugaggg

SEQ ID NO: 3336 - RNA, 19 nt, Artificial Sequence
  siRNA Sense Sequence
ccucaucccuguccuagcc

SEQ ID NO: 3337 - RNA, 19 nt, Artificial Sequence
  siRNA Antisense Sequence
ggcuaggacagggaugagg

SEQ ID NO: 3338 - RNA, 19 nt, Artificial Sequence
  siRNA Sense Sequence
gaauuuuccuucuggccua

SEQ ID NO: 3339 - RNA, 19 nt, Artificial Sequence
  siRNA Antisense Sequence
uaggccagaaggaaaauuc

SEQ ID NO: 3340 - RNA, 19 nt, Artificial Sequence
  siRNA Sense Sequence
aauuuuccuucuggccuaa

SEQ ID NO: 3341 - RNA, 19 nt, Artificial Sequence
  siRNA Antisense Sequence
uuaggccagaaggaaaauu

SEQ ID NO: 3342 - RNA, 19 nt, Artificial Sequence
  siRNA Sense Sequence
ugcugcagcaguggugaag

SEQ ID NO: 3343 - RNA, 19 nt, Artificial Sequence
  siRNA Antisense Sequence
cuucaccacugcugcagca

SEQ ID NO: 3344 - RNA, 19 nt, Artificial Sequence
  siRNA Sense Sequence
gcugcagcaguggugaagc

SEQ ID NO: 3345 - RNA, 19 nt, Artificial Sequence
  siRNA Antisense Sequence
gcuucaccacugcugcagc

SEQ ID NO: 3346 - RNA, 19 nt, Artificial Sequence
  siRNA Sense Sequence
cugcagcaguggugaagcu

SEQ ID NO: 3347 - RNA, 19 nt, Artificial Sequence
  siRNA Antisense Sequence
agcuucaccacugcugcag

SEQ ID NO: 3348 - RNA, 19 nt, Artificial Sequence
  siRNA Sense Sequence
ugcagcaguggugaagcua

SEQ ID NO: 3349 - RNA, 19 nt, Artificial Sequence
  siRNA Antisense Sequence
uagcuucaccacugcugca

SEQ ID NO: 3350 - RNA, 19 nt, Artificial Sequence
  siRNA Sense Sequence
aaagacuagagguaugagg

SEQ ID NO: 3351 - RNA, 19 nt, Artificial Sequence
  siRNA Antisense Sequence
ccucauaccucuagucuuu

SEQ ID NO: 3352 - RNA, 19 nt, Artificial Sequence
  siRNA Sense Sequence
aagacuagagguaugaggg

SEQ ID NO: 3353 - RNA, 19 nt, Artificial Sequence
  siRNA Antisense Sequence
cccucauaccucuagucuu

SEQ ID NO: 3354 - RNA, 19 nt, Artificial Sequence
  siRNA Sense Sequence
agacuagagguaugaggga

SEQ ID NO: 3355 - RNA, 19 nt, Artificial Sequence
  siRNA Antisense Sequence
ucccucauaccucuagucu

SEQ ID NO: 3356 - RNA, 19 nt, Artificial Sequence
  siRNA Sense Sequence
gacuagagguaugagggaa

SEQ ID NO: 3357 - RNA, 19 nt, Artificial Sequence
  siRNA Antisense Sequence
uucccucauaccucuaguc

SEQ ID NO: 3358 - RNA, 19 nt, Artificial Sequence
  siRNA Sense Sequence
cccaccuggcucauaaggc

SEQ ID NO: 3359 - RNA, 19 nt, Artificial Sequence
  siRNA Antisense Sequence
gccuuaugagccagguggg

SEQ ID NO: 3360 - RNA, 19 nt, Artificial Sequence
  siRNA Sense Sequence
ccaccuggcucauaaggcg

SEQ ID NO: 3361 - RNA, 19 nt, Artificial Sequence
  siRNA Antisense Sequence
cgccuuaugagccaggugg

SEQ ID NO: 3362 - RNA, 19 nt, Artificial Sequence
  siRNA Sense Sequence
caccuggcucauaaggcgu

SEQ ID NO: 3363 - RNA, 19 nt, Artificial Sequence
  siRNA Antisense Sequence
acgccuuaugagccaggug

SEQ ID NO: 3364 - RNA, 19 nt, Artificial Sequence
  siRNA Sense Sequence
accuggcucauaaggcguu

SEQ ID NO: 3365 - RNA, 19 nt, Artificial Sequence
  siRNA Antisense Sequence
aacgccuuaugagccaggu

SEQ ID NO: 3366 - RNA, 19 nt, Artificial Sequence
  siRNA Sense Sequence
cuggcucauaaggcguucc

SEQ ID NO: 3367 - RNA, 19 nt, Artificial Sequence
  siRNA Antisense Sequence
ggaacgccuuaugagccag

SEQ ID NO: 3368 - RNA, 19 nt, Artificial Sequence
  siRNA Sense Sequence
cucauaaggcguucccucc

SEQ ID NO: 3369 - RNA, 19 nt, Artificial Sequence
  siRNA Antisense Sequence
ggagggaacgccuuaugag

SEQ ID NO: 3370 - RNA, 19 nt, Artificial Sequence
  siRNA Sense Sequence
ucauaaggcguucccuccc

SEQ ID NO: 3371 - RNA, 19 nt, Artificial Sequence
  siRNA Antisense Sequence
gggagggaacgccuuauga

SEQ ID NO: 3372 - RNA, 19 nt, Artificial Sequence
  siRNA Sense Sequence
aaaucauccucuuucuugc

SEQ ID NO: 3373 - RNA, 19 nt, Artificial Sequence
  siRNA Antisense Sequence
gcaagaaagaggaugauuu

SEQ ID NO: 3374 - RNA, 19 nt, Artificial Sequence
  siRNA Sense Sequence
aaucauccucuuucuugca

SEQ ID NO: 3375 - RNA, 19 nt, Artificial Sequence
  siRNA Antisense Sequence
ugcaagaaagaggaugauu

SEQ ID NO: 3376 - RNA, 19 nt, Artificial Sequence
  siRNA Sense Sequence
ucauccucuuucuugcauc

SEQ ID NO: 3377 - RNA, 19 nt, Artificial Sequence
  siRNA Antisense Sequence
gaugcaagaaagaggauga

SEQ ID NO: 3378 - RNA, 19 nt, Artificial Sequence
  siRNA Sense Sequence
cauccucuuucuugcauca

SEQ ID NO: 3379 - RNA, 19 nt, Artificial Sequence
  siRNA Antisense Sequence
ugaugcaagaaagaggaug

SEQ ID NO: 3380 - RNA, 19 nt, Artificial Sequence
  siRNA Sense Sequence
auccucuuucuugcaucau

SEQ ID NO: 3381 - RNA, 19 nt, Artificial Sequence
  siRNA Antisense Sequence
augaugcaagaaagaggau

SEQ ID NO: 3382 - RNA, 19 nt, Artificial Sequence
  siRNA Sense Sequence
uccucuuucuugcaucaug

SEQ ID NO: 3383 - RNA, 19 nt, Artificial Sequence
  siRNA Antisense Sequence
caugaugcaagaaagagga

SEQ ID NO: 3384 - RNA, 19 nt, Artificial Sequence
  siRNA Sense Sequence
cucuuucuugcaucaugcg

SEQ ID NO: 3385 - RNA, 19 nt, Artificial Sequence
  siRNA Antisense Sequence
cgcaugaugcaagaaagag

SEQ ID NO: 3386 - RNA, 19 nt, Artificial Sequence
  siRNA Sense Sequence
ucuuucuugcaucaugcgu

SEQ ID NO: 3387 - RNA, 19 nt, Artificial Sequence
  siRNA Antisense Sequence
acgcaugaugcaagaaaga

SEQ ID NO: 3388 - RNA, 19 nt, Artificial Sequence
  siRNA Sense Sequence
cuuucuugcaucaugcgug

SEQ ID NO: 3389 - RNA, 19 nt, Artificial Sequence
  siRNA Antisense Sequence
cacgcaugaugcaagaaag

SEQ ID NO: 3390 - RNA, 19 nt, Artificial Sequence
  siRNA Sense Sequence
uuucuugcaucaugcgugu

SEQ ID NO: 3391 - RNA, 19 nt, Artificial Sequence
  siRNA Antisense Sequence
acacgcaugaugcaagaaa

SEQ ID NO: 3392 - RNA, 19 nt, Artificial Sequence
  siRNA Sense Sequence
uucuugcaucaugcguguc

SEQ ID NO: 3393 - RNA, 19 nt, Artificial Sequence
  siRNA Antisense Sequence
gacacgcaugaugcaagaa

SEQ ID NO: 3394 - RNA, 19 nt, Artificial Sequence
  siRNA Sense Sequence
ucuugcaucaugcgugucc

SEQ ID NO: 3395 - RNA, 19 nt, Artificial Sequence
  siRNA Antisense Sequence
ggacacgcaugaugcaaga

SEQ ID NO: 3396 - RNA, 19 nt, Artificial Sequence
  siRNA Sense Sequence
cuugcaucaugcgugucca

SEQ ID NO: 3397 - RNA, 19 nt, Artificial Sequence
  siRNA Antisense Sequence
uggacacgcaugaugcaag

SEQ ID NO: 3398 - RNA, 19 nt, Artificial Sequence
  siRNA Sense Sequence
ucaugcguguccacauugc

SEQ ID NO: 3399 - RNA, 19 nt, Artificial Sequence
  siRNA Antisense Sequence
gcaauguggacacgcauga

SEQ ID NO: 3400 - RNA, 19 nt, Artificial Sequence
  siRNA Sense Sequence
caugcguguccacauugca

SEQ ID NO: 3401 - RNA, 19 nt, Artificial Sequence
  siRNA Antisense Sequence
ugcaauguggacacgcaug

SEQ ID NO: 3402 - RNA, 19 nt, Artificial Sequence
  siRNA Sense Sequence
cccuacuucaggcccaguc

SEQ ID NO: 3403 - RNA, 19 nt, Artificial Sequence
  siRNA Antisense Sequence
gacugggccugaaguaggg

SEQ ID NO: 3404 - RNA, 19 nt, Artificial Sequence
  siRNA Sense Sequence
ccuacuucaggcccaguca

SEQ ID NO: 3405 - RNA, 19 nt, Artificial Sequence
  siRNA Antisense Sequence
ugacugggccugaaguagg

SEQ ID NO: 3406 - RNA, 19 nt, Artificial Sequence
  siRNA Sense Sequence
uucaggcccagucaccaug

SEQ ID NO: 3407 - RNA, 19 nt, Artificial Sequence
  siRNA Antisense Sequence
cauggugacugggccugaa

SEQ ID NO: 3408 - RNA, 19 nt, Artificial Sequence
  siRNA Sense Sequence
ucaggcccagucaccaugg

SEQ ID NO: 3409 - RNA, 19 nt, Artificial Sequence
  siRNA Antisense Sequence
ccauggugacugggccuga

SEQ ID NO: 3410 - RNA, 19 nt, Artificial Sequence
  siRNA Sense Sequence
ccagucaccauggccagau

SEQ ID NO: 3411 - RNA, 19 nt, Artificial Sequence
  siRNA Antisense Sequence
aucuggccauggugacugg

SEQ ID NO: 3412 - RNA, 19 nt, Artificial Sequence
  siRNA Sense Sequence
cagucaccauggccagaug

SEQ ID NO: 3413 - RNA, 19 nt, Artificial Sequence
  siRNA Antisense Sequence
caucuggccauggugacug

SEQ ID NO: 3414 - RNA, 19 nt, Artificial Sequence
  siRNA Sense Sequence
agcacagcuggccaauccu

SEQ ID NO: 3415 - RNA, 19 nt, Artificial Sequence
  siRNA Antisense Sequence
aggauuggccagcugugcu

SEQ ID NO: 3416 - RNA, 19 nt, Artificial Sequence
  siRNA Sense Sequence
gcacagcuggccaauccug

SEQ ID NO: 3417 - RNA, 19 nt, Artificial Sequence
  siRNA Antisense Sequence
caggauuggccagcugugc

SEQ ID NO: 3418 - RNA, 19 nt, Artificial Sequence
  siRNA Sense Sequence
agcuggccaauccugggac

SEQ ID NO: 3419 - RNA, 19 nt, Artificial Sequence
  siRNA Antisense Sequence
gucccaggauuggccagcu

SEQ ID NO: 3420 - RNA, 19 nt, Artificial Sequence
  siRNA Sense Sequence
gcuggccaauccugggacu

SEQ ID NO: 3421 - RNA, 19 nt, Artificial Sequence
  siRNA Antisense Sequence
agucccaggauuggccagc

SEQ ID NO: 3422 - RNA, 19 nt, Artificial Sequence
  siRNA Sense Sequence
cuggccaauccugggacuc

SEQ ID NO: 3423 - RNA, 19 nt, Artificial Sequence
  siRNA Antisense Sequence
gagucccaggauuggccag

SEQ ID NO: 3424 - RNA, 19 nt, Artificial Sequence
  siRNA Sense Sequence
uggccaauccugggacuca

SEQ ID NO: 3425 - RNA, 19 nt, Artificial Sequence
  siRNA Antisense Sequence
ugagucccaggauuggcca

SEQ ID NO: 3426 - RNA, 19 nt, Artificial Sequence
  siRNA Sense Sequence
auccugggacucagagggu

SEQ ID NO: 3427 - RNA, 19 nt, Artificial Sequence
  siRNA Antisense Sequence
acccucugagucccaggau

SEQ ID NO: 3428 - RNA, 19 nt, Artificial Sequence
  siRNA Sense Sequence
uccugggacucagagggua

SEQ ID NO: 3429 - RNA, 19 nt, Artificial Sequence
  siRNA Antisense Sequence
uacccucugagucccagga

SEQ ID NO: 3430 - RNA, 19 nt, Artificial Sequence
  siRNA Sense Sequence
ccugggacucagaggguag

SEQ ID NO: 3431 - RNA, 19 nt, Artificial Sequence
  siRNA Antisense Sequence
cuacccucugagucccagg

SEQ ID NO: 3432 - RNA, 19 nt, Artificial Sequence
  siRNA Sense Sequence
cugggacucagaggguagg

SEQ ID NO: 3433 - RNA, 19 nt, Artificial Sequence
  siRNA Antisense Sequence
ccuacccucugagucccag

SEQ ID NO: 3434 - RNA, 19 nt, Artificial Sequence
  siRNA Sense Sequence
ggacucagaggguaggucg

SEQ ID NO: 3435 - RNA, 19 nt, Artificial Sequence
  siRNA Antisense Sequence
cgaccuacccucugagucc

SEQ ID NO: 3436 - RNA, 19 nt, Artificial Sequence
  siRNA Sense Sequence
gacucagaggguaggucgg

SEQ ID NO: 3437 - RNA, 19 nt, Artificial Sequence
  siRNA Antisense Sequence
ccgaccuacccucugaguc

SEQ ID NO: 3438 - RNA, 19 nt, Artificial Sequence
  siRNA Sense Sequence
acucagaggguaggucggc

SEQ ID NO: 3439 - RNA, 19 nt, Artificial Sequence
  siRNA Antisense Sequence
gccgaccuacccucugagu

SEQ ID NO: 3440 - RNA, 19 nt, Artificial Sequence
  siRNA Sense Sequence
cucagaggguaggucggcu

SEQ ID NO: 3441 - RNA, 19 nt, Artificial Sequence
  siRNA Antisense Sequence
agccgaccuacccucugag

SEQ ID NO: 3442 - RNA, 19 nt, Artificial Sequence
  siRNA Sense Sequence
ucagaggguaggucggcug

SEQ ID NO: 3443 - RNA, 19 nt, Artificial Sequence
  siRNA Antisense Sequence
cagccgaccuacccucuga

SEQ ID NO: 3444 - RNA, 19 nt, Artificial Sequence
  siRNA Sense Sequence
ggcuggcugaccacuaggu

SEQ ID NO: 3445 - RNA, 19 nt, Artificial Sequence
  siRNA Antisense Sequence
accuaguggucagccagcc

SEQ ID NO: 3446 - RNA, 19 nt, Artificial Sequence
  siRNA Sense Sequence
gcuggcugaccacuagguu

SEQ ID NO: 3447 - RNA, 19 nt, Artificial Sequence
  siRNA Antisense Sequence
aaccuaguggucagccagc

SEQ ID NO: 3448 - RNA, 19 nt, Artificial Sequence
  siRNA Sense Sequence
cuggcugaccacuagguuu

SEQ ID NO: 3449 - RNA, 19 nt, Artificial Sequence
  siRNA Antisense Sequence
aaaccuaguggucagccag

SEQ ID NO: 3450 - RNA, 19 nt, Artificial Sequence
  siRNA Sense Sequence
cugaccacuagguuuggaa

SEQ ID NO: 3451 - RNA, 19 nt, Artificial Sequence
  siRNA Antisense Sequence
uuccaaaccuaguggucag

SEQ ID NO: 3452 - RNA, 19 nt, Artificial Sequence
  siRNA Sense Sequence
ugaccacuagguuuggaag

SEQ ID NO: 3453 - RNA, 19 nt, Artificial Sequence
  siRNA Antisense Sequence
cuuccaaaccuagugguca

SEQ ID NO: 3454 - RNA, 19 nt, Artificial Sequence
  siRNA Sense Sequence
gaccacuagguuuggaaga

SEQ ID NO: 3455 - RNA, 19 nt, Artificial Sequence
  siRNA Antisense Sequence
ucuuccaaaccuagugguc

SEQ ID NO: 3456 - RNA, 19 nt, Artificial Sequence
  siRNA Sense Sequence
accacuagguuuggaagac

SEQ ID NO: 3457 - RNA, 19 nt, Artificial Sequence
  siRNA Antisense Sequence
gucuuccaaaccuaguggu

SEQ ID NO: 3458 - RNA, 19 nt, Artificial Sequence
  siRNA Sense Sequence
ccacuagguuuggaagacc

SEQ ID NO: 3459 - RNA, 19 nt, Artificial Sequence
  siRNA Antisense Sequence
ggucuuccaaaccuagugg

SEQ ID NO: 3460 - RNA, 19 nt, Artificial Sequence
  siRNA Sense Sequence
uagguuuggaagacccagg

SEQ ID NO: 3461 - RNA, 19 nt, Artificial Sequence
  siRNA Antisense Sequence
ccugggucuuccaaaccua

SEQ ID NO: 3462 - RNA, 19 nt, Artificial Sequence
  siRNA Sense Sequence
agguuuggaagacccaggc

SEQ ID NO: 3463 - RNA, 19 nt, Artificial Sequence
  siRNA Antisense Sequence
gccugggucuuccaaaccu

SEQ ID NO: 3464 - RNA, 19 nt, Artificial Sequence
  siRNA Sense Sequence
caggcagcuggcucuaaag

SEQ ID NO: 3465 - RNA, 19 nt, Artificial Sequence
  siRNA Antisense Sequence
cuuuagagccagcugccug

SEQ ID NO: 3466 - RNA, 19 nt, Artificial Sequence
  siRNA Sense Sequence
aggcagcuggcucuaaaga

SEQ ID NO: 3467 - RNA, 19 nt, Artificial Sequence
  siRNA Antisense Sequence
ucuuuagagccagcugccu

SEQ ID NO: 3468 - RNA, 19 nt, Artificial Sequence
  siRNA Sense Sequence
agcuggcucuaaagaggcc

SEQ ID NO: 3469 - RNA, 19 nt, Artificial Sequence
  siRNA Antisense Sequence
ggccucuuuagagccagcu

SEQ ID NO: 3470 - RNA, 19 nt, Artificial Sequence
  siRNA Sense Sequence
gcuggcucuaaagaggccc

SEQ ID NO: 3471 - RNA, 19 nt, Artificial Sequence
  siRNA Antisense Sequence
gggccucuuuagagccagc

SEQ ID NO: 3472 - RNA, 19 nt, Artificial Sequence
  siRNA Sense Sequence
ccaggucaguagccagaca

SEQ ID NO: 3473 - RNA, 19 nt, Artificial Sequence
  siRNA Antisense Sequence
ugucuggcuacugaccugg

SEQ ID NO: 3474 - RNA, 19 nt, Artificial Sequence
  siRNA Sense Sequence
gucaguagccagacaugag

SEQ ID NO: 3475 - RNA, 19 nt, Artificial Sequence
  siRNA Antisense Sequence
cucaugucuggcuacugac

SEQ ID NO: 3476 - RNA, 19 nt, Artificial Sequence
  siRNA Sense Sequence
guagccagacaugagcugu

SEQ ID NO: 3477 - RNA, 19 nt, Artificial Sequence
  siRNA Antisense Sequence
acagcucaugucuggcuac

SEQ ID NO: 3478 - RNA, 19 nt, Artificial Sequence
  siRNA Sense Sequence
agacaugagcugugagggu

SEQ ID NO: 3479 - RNA, 19 nt, Artificial Sequence
  siRNA Antisense Sequence
acccucacagcucaugucu

SEQ ID NO: 3480 - RNA, 19 nt, Artificial Sequence
  siRNA Sense Sequence
augagcugugagggucaag

SEQ ID NO: 3481 - RNA, 19 nt, Artificial Sequence
  siRNA Antisense Sequence
cuugacccucacagcucau

SEQ ID NO: 3482 - RNA, 19 nt, Artificial Sequence
  siRNA Sense Sequence
ugagcugugagggucaagc

SEQ ID NO: 3483 - RNA, 19 nt, Artificial Sequence
  siRNA Antisense Sequence
gcuugacccucacagcuca

SEQ ID NO: 3484 - RNA, 19 nt, Artificial Sequence
  siRNA Sense Sequence
gagcugugagggucaagca

SEQ ID NO: 3485 - RNA, 19 nt, Artificial Sequence
  siRNA Antisense Sequence
ugcuugacccucacagcuc

SEQ ID NO: 3486 - RNA, 19 nt, Artificial Sequence
  siRNA Sense Sequence
agcugugagggucaagcac

SEQ ID NO: 3487 - RNA, 19 nt, Artificial Sequence
  siRNA Antisense Sequence
gugcuugacccucacagcu

SEQ ID NO: 3488 - RNA, 19 nt, Artificial Sequence
  siRNA Sense Sequence
gugagggucaagcacagcu

SEQ ID NO: 3489 - RNA, 19 nt, Artificial Sequence
  siRNA Antisense Sequence
agcugugcuugacccucac

SEQ ID NO: 3490 - RNA, 19 nt, Artificial Sequence
  siRNA Sense Sequence
ugagggucaagcacagcua

SEQ ID NO: 3491 - RNA, 19 nt, Artificial Sequence
  siRNA Antisense Sequence
uagcugugcuugacccuca

SEQ ID NO: 3492 - RNA, 19 nt, Artificial Sequence
  siRNA Sense Sequence
gagggucaagcacagcuau

SEQ ID NO: 3493 - RNA, 19 nt, Artificial Sequence
  siRNA Antisense Sequence
auagcugugcuugacccuc

SEQ ID NO: 3494 - RNA, 19 nt, Artificial Sequence
  siRNA Sense Sequence
agggucaagcacagcuauc

SEQ ID NO: 3495 - RNA, 19 nt, Artificial Sequence
  siRNA Antisense Sequence
gauagcugugcuugacccu

SEQ ID NO: 3496 - RNA, 19 nt, Artificial Sequence
  siRNA Sense Sequence
gggucaagcacagcuaucc

SEQ ID NO: 3497 - RNA, 19 nt, Artificial Sequence
  siRNA Antisense Sequence
ggauagcugugcuugaccc

SEQ ID NO: 3498 - RNA, 19 nt, Artificial Sequence
  siRNA Sense Sequence
caagcacagcuauccauca

SEQ ID NO: 3499 - RNA, 19 nt, Artificial Sequence
  siRNA Antisense Sequence
ugauggauagcugugcuug

SEQ ID NO: 3500 - RNA, 19 nt, Artificial Sequence
  siRNA Sense Sequence
cacagcuauccaucagaug

SEQ ID NO: 3501 - RNA, 19 nt, Artificial Sequence
  siRNA Antisense Sequence
caucugauggauagcugug

SEQ ID NO: 3502 - RNA, 19 nt, Artificial Sequence
  siRNA Sense Sequence
acagcuauccaucagauga

SEQ ID NO: 3503 - RNA, 19 nt, Artificial Sequence
  siRNA Antisense Sequence
ucaucugauggauagcugu

SEQ ID NO: 3504 - RNA, 19 nt, Artificial Sequence
  siRNA Sense Sequence
cagcuauccaucagaugau

SEQ ID NO: 3505 - RNA, 19 nt, Artificial Sequence
  siRNA Antisense Sequence
aucaucugauggauagcug

SEQ ID NO: 3506 - RNA, 19 nt, Artificial Sequence
  siRNA Sense Sequence
agcuauccaucagaugauc

SEQ ID NO: 3507 - RNA, 19 nt, Artificial Sequence
  siRNA Antisense Sequence
gaucaucugauggauagcu

SEQ ID NO: 3508 - RNA, 19 nt, Artificial Sequence
  siRNA Sense Sequence
gcuauccaucagaugaucu

SEQ ID NO: 3509 - RNA, 19 nt, Artificial Sequence
  siRNA Antisense Sequence
agaucaucugauggauagc

SEQ ID NO: 3510 - RNA, 19 nt, Artificial Sequence
  siRNA Sense Sequence
cuauccaucagaugaucua

SEQ ID NO: 3511 - RNA, 19 nt, Artificial Sequence
  siRNA Antisense Sequence
uagaucaucugauggauag

SEQ ID NO: 3512 - RNA, 19 nt, Artificial Sequence
  siRNA Sense Sequence
caucagaugaucuacuuuc

SEQ ID NO: 3513 - RNA, 19 nt, Artificial Sequence
  siRNA Antisense Sequence
gaaaguagaucaucugaug

SEQ ID NO: 3514 - RNA, 19 nt, Artificial Sequence
  siRNA Sense Sequence
agaugaucuacuuucagcc

SEQ ID NO: 3515 - RNA, 19 nt, Artificial Sequence
  siRNA Antisense Sequence
ggcugaaaguagaucaucu

SEQ ID NO: 3516 - RNA, 19 nt, Artificial Sequence
  siRNA Sense Sequence
gaucuacuuucagccuucc

SEQ ID NO: 3517 - RNA, 19 nt, Artificial Sequence
  siRNA Antisense Sequence
ggaaggcugaaaguagauc

SEQ ID NO: 3518 - RNA, 19 nt, Artificial Sequence
  siRNA Sense Sequence
aucuacuuucagccuuccu

SEQ ID NO: 3519 - RNA, 19 nt, Artificial Sequence
  siRNA Antisense Sequence
aggaaggcugaaaguagau

SEQ ID NO: 3520 - RNA, 19 nt, Artificial Sequence
  siRNA Sense Sequence
caauagaagacagguggcu

SEQ ID NO: 3521 - RNA, 19 nt, Artificial Sequence
  siRNA Antisense Sequence
agccaccugucuucuauug

SEQ ID NO: 3522 - RNA, 19 nt, Artificial Sequence
  siRNA Sense Sequence
aauagaagacagguggcug

SEQ ID NO: 3523 - RNA, 19 nt, Artificial Sequence
  siRNA Antisense Sequence
cagccaccugucuucuauu

SEQ ID NO: 3524 - RNA, 19 nt, Artificial Sequence
  siRNA Sense Sequence
cagguggcuguacccuugg

SEQ ID NO: 3525 - RNA, 19 nt, Artificial Sequence
  siRNA Antisense Sequence
ccaaggguacagccaccug

SEQ ID NO: 3526 - RNA, 19 nt, Artificial Sequence
  siRNA Sense Sequence
agguggcuguacccuuggc

SEQ ID NO: 3527 - RNA, 19 nt, Artificial Sequence
  siRNA Antisense Sequence
gccaaggguacagccaccu

SEQ ID NO: 3528 - RNA, 19 nt, Artificial Sequence
  siRNA Sense Sequence
ggcuguacccuuggccaag

SEQ ID NO: 3529 - RNA, 19 nt, Artificial Sequence
  siRNA Antisense Sequence
cuuggccaaggguacagcc

SEQ ID NO: 3530 - RNA, 19 nt, Artificial Sequence
  siRNA Sense Sequence
uggugucugcugucacugu

SEQ ID NO: 3531 - RNA, 19 nt, Artificial Sequence
  siRNA Antisense Sequence
acagugacagcagacacca

SEQ ID NO: 3532 - RNA, 19 nt, Artificial Sequence
  siRNA Sense Sequence
gucugcugucacugugccc

SEQ ID NO: 3533 - RNA, 19 nt, Artificial Sequence
  siRNA Antisense Sequence
gggcacagugacagcagac

SEQ ID NO: 3534 - RNA, 19 nt, Artificial Sequence
  siRNA Sense Sequence
cugcugucacugugcccuc

SEQ ID NO: 3535 - RNA, 19 nt, Artificial Sequence
  siRNA Antisense Sequence
gagggcacagugacagcag

SEQ ID NO: 3536 - RNA, 19 nt, Artificial Sequence
  siRNA Sense Sequence
ugcugucacugugcccuca

SEQ ID NO: 3537 - RNA, 19 nt, Artificial Sequence
  siRNA Antisense Sequence
ugagggcacagugacagca

SEQ ID NO: 3538 - RNA, 19 nt, Artificial Sequence
  siRNA Sense Sequence
gcugucacugugcccucau

SEQ ID NO: 3539 - RNA, 19 nt, Artificial Sequence
  siRNA Antisense Sequence
augagggcacagugacagc

SEQ ID NO: 3540 - RNA, 19 nt, Artificial Sequence
  siRNA Sense Sequence
cugucacugugcccucauu

SEQ ID NO: 3541 - RNA, 19 nt, Artificial Sequence
  siRNA Antisense Sequence
aaugagggcacagugacag

SEQ ID NO: 3542 - RNA, 19 nt, Artificial Sequence
  siRNA Sense Sequence
ugucacugugcccucauug

SEQ ID NO: 3543 - RNA, 19 nt, Artificial Sequence
  siRNA Antisense Sequence
caaugagggcacagugaca

SEQ ID NO: 3544 - RNA, 19 nt, Artificial Sequence
  siRNA Sense Sequence
gucacugugcccucauugg

SEQ ID NO: 3545 - RNA, 19 nt, Artificial Sequence
  siRNA Antisense Sequence
ccaaugagggcacagugac

SEQ ID NO: 3546 - RNA, 19 nt, Artificial Sequence
  siRNA Sense Sequence
acugugcccucauuggccc

SEQ ID NO: 3547 - RNA, 19 nt, Artificial Sequence
  siRNA Antisense Sequence
gggccaaugagggcacagu

SEQ ID NO: 3548 - RNA, 19 nt, Artificial Sequence
  siRNA Sense Sequence
cccagcaaucagacucaac

SEQ ID NO: 3549 - RNA, 19 nt, Artificial Sequence
  siRNA Antisense Sequence
guugagucugauugcuggg

SEQ ID NO: 3550 - RNA, 19 nt, Artificial Sequence
  siRNA Sense Sequence
ggagcaacugccauccgag

SEQ ID NO: 3551 - RNA, 19 nt, Artificial Sequence
  siRNA Antisense Sequence
cucggauggcaguugcucc

SEQ ID NO: 3552 - RNA, 19 nt, Artificial Sequence
  siRNA Sense Sequence
gagcaacugccauccgagg

SEQ ID NO: 3553 - RNA, 19 nt, Artificial Sequence
  siRNA Antisense Sequence
ccucggauggcaguugcuc

SEQ ID NO: 3554 - RNA, 19 nt, Artificial Sequence
  siRNA Sense Sequence
agcaacugccauccgaggc

SEQ ID NO: 3555 - RNA, 19 nt, Artificial Sequence
  siRNA Antisense Sequence
gccucggauggcaguugcu

SEQ ID NO: 3556 - RNA, 19 nt, Artificial Sequence
  siRNA Sense Sequence
gcaacugccauccgaggcu

SEQ ID NO: 3557 - RNA, 19 nt, Artificial Sequence
  siRNA Antisense Sequence
agccucggauggcaguugc

SEQ ID NO: 3558 - RNA, 19 nt, Artificial Sequence
  siRNA Sense Sequence
caacugccauccgaggcuc

SEQ ID NO: 3559 - RNA, 19 nt, Artificial Sequence
  siRNA Antisense Sequence
gagccucggauggcaguug

SEQ ID NO: 3560 - RNA, 19 nt, Artificial Sequence
  siRNA Sense Sequence
gccauccgaggcuccugaa

SEQ ID NO: 3561 - RNA, 19 nt, Artificial Sequence
  siRNA Antisense Sequence
uucaggagccucggauggc

SEQ ID NO: 3562 - RNA, 19 nt, Artificial Sequence
  siRNA Sense Sequence
aaccagggccauucaccag

SEQ ID NO: 3563 - RNA, 19 nt, Artificial Sequence
  siRNA Antisense Sequence
cuggugaauggcccugguu

SEQ ID NO: 3564 - RNA, 19 nt, Artificial Sequence
  siRNA Sense Sequence
accagggccauucaccagg

SEQ ID NO: 3565 - RNA, 19 nt, Artificial Sequence
  siRNA Antisense Sequence
ccuggugaauggcccuggu

SEQ ID NO: 3566 - RNA, 19 nt, Artificial Sequence
  siRNA Sense Sequence
ccagggccauucaccagga

SEQ ID NO: 3567 - RNA, 19 nt, Artificial Sequence
  siRNA Antisense Sequence
uccuggugaauggcccugg

SEQ ID NO: 3568 - RNA, 19 nt, Artificial Sequence
  siRNA Sense Sequence
cagggccauucaccaggag

SEQ ID NO: 3569 - RNA, 19 nt, Artificial Sequence
  siRNA Antisense Sequence
cuccuggugaauggcccug

SEQ ID NO: 3570 - RNA, 19 nt, Artificial Sequence
  siRNA Sense Sequence
ggccauucaccaggagcau

SEQ ID NO: 3571 - RNA, 19 nt, Artificial Sequence
  siRNA Antisense Sequence
augcuccuggugaauggcc

SEQ ID NO: 3572 - RNA, 19 nt, Artificial Sequence
  siRNA Sense Sequence
gccauucaccaggagcaug

SEQ ID NO: 3573 - RNA, 19 nt, Artificial Sequence
  siRNA Antisense Sequence
caugcuccuggugaauggc

SEQ ID NO: 3574 - RNA, 19 nt, Artificial Sequence
  siRNA Sense Sequence
ccauucaccaggagcaugc

SEQ ID NO: 3575 - RNA, 19 nt, Artificial Sequence
  siRNA Antisense Sequence
gcaugcuccuggugaaugg

SEQ ID NO: 3576 - RNA, 19 nt, Artificial Sequence
  siRNA Sense Sequence
cauucaccaggagcaugcg

SEQ ID NO: 3577 - RNA, 19 nt, Artificial Sequence
  siRNA Antisense Sequence
cgcaugcuccuggugaaug

SEQ ID NO: 3578 - RNA, 19 nt, Artificial Sequence
  siRNA Sense Sequence
auucaccaggagcaugcgg

SEQ ID NO: 3579 - RNA, 19 nt, Artificial Sequence
  siRNA Antisense Sequence
ccgcaugcuccuggugaau

SEQ ID NO: 3580 - RNA, 19 nt, Artificial Sequence
  siRNA Sense Sequence
uucaccaggagcaugcggc

SEQ ID NO: 3581 - RNA, 19 nt, Artificial Sequence
  siRNA Antisense Sequence
gccgcaugcuccuggugaa

SEQ ID NO: 3582 - RNA, 19 nt, Artificial Sequence
  siRNA Sense Sequence
ucaccaggagcaugcggcu

SEQ ID NO: 3583 - RNA, 19 nt, Artificial Sequence
  siRNA Antisense Sequence
agccgcaugcuccugguga

SEQ ID NO: 3584 - RNA, 19 nt, Artificial Sequence
  siRNA Sense Sequence
agcaugcggcucccugaug

SEQ ID NO: 3585 - RNA, 19 nt, Artificial Sequence
  siRNA Antisense Sequence
caucagggagccgcaugcu

SEQ ID NO: 3586 - RNA, 19 nt, Artificial Sequence
  siRNA Sense Sequence
gcaugcggcucccugaugu

SEQ ID NO: 3587 - RNA, 19 nt, Artificial Sequence
  siRNA Antisense Sequence
acaucagggagccgcaugc

SEQ ID NO: 3588 - RNA, 19 nt, Artificial Sequence
  siRNA Sense Sequence
caugcggcucccugauguc

SEQ ID NO: 3589 - RNA, 19 nt, Artificial Sequence
  siRNA Antisense Sequence
gacaucagggagccgcaug

SEQ ID NO: 3590 - RNA, 19 nt, Artificial Sequence
  siRNA Sense Sequence
augcggcucccugaugucc

SEQ ID NO: 3591 - RNA, 19 nt, Artificial Sequence
  siRNA Antisense Sequence
ggacaucagggagccgcau

SEQ ID NO: 3592 - RNA, 19 nt, Artificial Sequence
  siRNA Sense Sequence
ugcggcucccugaugucca

SEQ ID NO: 3593 - RNA, 19 nt, Artificial Sequence
  siRNA Antisense Sequence
uggacaucagggagccgca

SEQ ID NO: 3594 - RNA, 19 nt, Artificial Sequence
  siRNA Sense Sequence
gcucccugauguccagcuc

SEQ ID NO: 3595 - RNA, 19 nt, Artificial Sequence
  siRNA Antisense Sequence
gagcuggacaucagggagc

SEQ ID NO: 3596 - RNA, 19 nt, Artificial Sequence
  siRNA Sense Sequence
cucccugauguccagcucu

SEQ ID NO: 3597 - RNA, 19 nt, Artificial Sequence
  siRNA Antisense Sequence
agagcuggacaucagggag

SEQ ID NO: 3598 - RNA, 19 nt, Artificial Sequence
  siRNA Sense Sequence
ucccugauguccagcucug

SEQ ID NO: 3599 - RNA, 19 nt, Artificial Sequence
  siRNA Antisense Sequence
cagagcuggacaucaggga

SEQ ID NO: 3600 - RNA, 19 nt, Artificial Sequence
  siRNA Sense Sequence
cccugauguccagcucugg

SEQ ID NO: 3601 - RNA, 19 nt, Artificial Sequence
  siRNA Antisense Sequence
ccagagcuggacaucaggg

SEQ ID NO: 3602 - RNA, 19 nt, Artificial Sequence
  siRNA Sense Sequence
ccugauguccagcucuggc

SEQ ID NO: 3603 - RNA, 19 nt, Artificial Sequence
  siRNA Antisense Sequence
gccagagcuggacaucagg

SEQ ID NO: 3604 - RNA, 19 nt, Artificial Sequence
  siRNA Sense Sequence
cugauguccagcucuggcu

SEQ ID NO: 3605 - RNA, 19 nt, Artificial Sequence
  siRNA Antisense Sequence
agccagagcuggacaucag

SEQ ID NO: 3606 - RNA, 19 nt, Artificial Sequence
  siRNA Sense Sequence
ucuggugcuggagcuagcc

SEQ ID NO: 3607 - RNA, 19 nt, Artificial Sequence
  siRNA Antisense Sequence
ggcuagcuccagcaccaga

SEQ ID NO: 3608 - RNA, 19 nt, Artificial Sequence
  siRNA Sense Sequence
uggugcuggagcuagccaa

SEQ ID NO: 3609 - RNA, 19 nt, Artificial Sequence
  siRNA Antisense Sequence
uuggcuagcuccagcacca

SEQ ID NO: 3610 - RNA, 19 nt, Artificial Sequence
  siRNA Sense Sequence
ggugcuggagcuagccaag

SEQ ID NO: 3611 - RNA, 19 nt, Artificial Sequence
  siRNA Antisense Sequence
cuuggcuagcuccagcacc

SEQ ID NO: 3612 - RNA, 19 nt, Artificial Sequence
  siRNA Sense Sequence
gugcuggagcuagccaagc

SEQ ID NO: 3613 - RNA, 19 nt, Artificial Sequence
  siRNA Antisense Sequence
gcuuggcuagcuccagcac

SEQ ID NO: 3614 - RNA, 19 nt, Artificial Sequence
  siRNA Sense Sequence
gcuggagcuagccaagcag

SEQ ID NO: 3615 - RNA, 19 nt, Artificial Sequence
  siRNA Antisense Sequence
cugcuuggcuagcuccagc

SEQ ID NO: 3616 - RNA, 19 nt, Artificial Sequence
  siRNA Sense Sequence
cuggagcuagccaagcagc

SEQ ID NO: 3617 - RNA, 19 nt, Artificial Sequence
  siRNA Antisense Sequence
gcugcuuggcuagcuccag

SEQ ID NO: 3618 - RNA, 19 nt, Artificial Sequence
  siRNA Sense Sequence
uggagcuagccaagcagca

SEQ ID NO: 3619 - RNA, 19 nt, Artificial Sequence
  siRNA Antisense Sequence
ugcugcuuggcuagcucca

SEQ ID NO: 3620 - RNA, 19 nt, Artificial Sequence
  siRNA Sense Sequence
ggagcuagccaagcagcaa

SEQ ID NO: 3621 - RNA, 19 nt, Artificial Sequence
  siRNA Antisense Sequence
uugcugcuuggcuagcucc

SEQ ID NO: 3622 - RNA, 19 nt, Artificial Sequence
  siRNA Sense Sequence
gagcuagccaagcagcaaa

SEQ ID NO: 3623 - RNA, 19 nt, Artificial Sequence
  siRNA Antisense Sequence
uuugcugcuuggcuagcuc

SEQ ID NO: 3624 - RNA, 19 nt, Artificial Sequence
  siRNA Sense Sequence
agcuagccaagcagcaaau

SEQ ID NO: 3625 - RNA, 19 nt, Artificial Sequence
  siRNA Antisense Sequence
auuugcugcuuggcuagcu

SEQ ID NO: 3626 - RNA, 19 nt, Artificial Sequence
  siRNA Sense Sequence
gcuagccaagcagcaaauc

SEQ ID NO: 3627 - RNA, 19 nt, Artificial Sequence
  siRNA Antisense Sequence
gauuugcugcuuggcuagc

SEQ ID NO: 3628 - RNA, 19 nt, Artificial Sequence
  siRNA Sense Sequence
cagcaaauccuggaugggu

SEQ ID NO: 3629 - RNA, 19 nt, Artificial Sequence
  siRNA Antisense Sequence
acccauccaggauuugcug

SEQ ID NO: 3630 - RNA, 19 nt, Artificial Sequence
  siRNA Sense Sequence
agcaaauccuggauggguu

SEQ ID NO: 3631 - RNA, 19 nt, Artificial Sequence
  siRNA Antisense Sequence
aacccauccaggauuugcu

SEQ ID NO: 3632 - RNA, 19 nt, Artificial Sequence
  siRNA Sense Sequence
gcaaauccuggauggguug

SEQ ID NO: 3633 - RNA, 19 nt, Artificial Sequence
  siRNA Antisense Sequence
caacccauccaggauuugc

SEQ ID NO: 3634 - RNA, 19 nt, Artificial Sequence
  siRNA Sense Sequence
caaauccuggauggguugc

SEQ ID NO: 3635 - RNA, 19 nt, Artificial Sequence
  siRNA Antisense Sequence
gcaacccauccaggauuug

SEQ ID NO: 3636 - RNA, 19 nt, Artificial Sequence
  siRNA Sense Sequence
aaauccuggauggguugca

SEQ ID NO: 3637 - RNA, 19 nt, Artificial Sequence
  siRNA Antisense Sequence
ugcaacccauccaggauuu

SEQ ID NO: 3638 - RNA, 19 nt, Artificial Sequence
  siRNA Sense Sequence
gguugcaccugaccagucg

SEQ ID NO: 3639 - RNA, 19 nt, Artificial Sequence
  siRNA Antisense Sequence
cgacuggucaggugcaacc

SEQ ID NO: 3640 - RNA, 19 nt, Artificial Sequence
  siRNA Sense Sequence
guugcaccugaccagucgu

SEQ ID NO: 3641 - RNA, 19 nt, Artificial Sequence
  siRNA Antisense Sequence
acgacuggucaggugcaac

SEQ ID NO: 3642 - RNA, 19 nt, Artificial Sequence
  siRNA Sense Sequence
uugcaccugaccagucguc

SEQ ID NO: 3643 - RNA, 19 nt, Artificial Sequence
  siRNA Antisense Sequence
gacgacuggucaggugcaa

SEQ ID NO: 3644 - RNA, 19 nt, Artificial Sequence
  siRNA Sense Sequence
ugcaccugaccagucgucc

SEQ ID NO: 3645 - RNA, 19 nt, Artificial Sequence
  siRNA Antisense Sequence
ggacgacuggucaggugca

SEQ ID NO: 3646 - RNA, 19 nt, Artificial Sequence
  siRNA Sense Sequence
ugaccagucgucccagaau

SEQ ID NO: 3647 - RNA, 19 nt, Artificial Sequence
  siRNA Antisense Sequence
auucugggacgacugguca

SEQ ID NO: 3648 - RNA, 19 nt, Artificial Sequence
  siRNA Sense Sequence
gaccagucgucccagaaua

SEQ ID NO: 3649 - RNA, 19 nt, Artificial Sequence
  siRNA Antisense Sequence
uauucugggacgacugguc

SEQ ID NO: 3650 - RNA, 19 nt, Artificial Sequence
  siRNA Sense Sequence
accagucgucccagaauaa

SEQ ID NO: 3651 - RNA, 19 nt, Artificial Sequence
  siRNA Antisense Sequence
uuauucugggacgacuggu

SEQ ID NO: 3652 - RNA, 19 nt, Artificial Sequence
  siRNA Sense Sequence
ccagucgucccagaauaac

SEQ ID NO: 3653 - RNA, 19 nt, Artificial Sequence
  siRNA Antisense Sequence
guuauucugggacgacugg

SEQ ID NO: 3654 - RNA, 19 nt, Artificial Sequence
  siRNA Sense Sequence
cagucgucccagaauaacu

SEQ ID NO: 3655 - RNA, 19 nt, Artificial Sequence
  siRNA Antisense Sequence
aguuauucugggacgacug

SEQ ID NO: 3656 - RNA, 19 nt, Artificial Sequence
  siRNA Sense Sequence
agucgucccagaauaacuc

SEQ ID NO: 3657 - RNA, 19 nt, Artificial Sequence
  siRNA Antisense Sequence
gaguuauucugggacgacu

SEQ ID NO: 3658 - RNA, 19 nt, Artificial Sequence
  siRNA Sense Sequence
gucgucccagaauaacuca

SEQ ID NO: 3659 - RNA, 19 nt, Artificial Sequence
  siRNA Antisense Sequence
ugaguuauucugggacgac

SEQ ID NO: 3660 - RNA, 19 nt, Artificial Sequence
  siRNA Sense Sequence
ucgucccagaauaacucau

SEQ ID NO: 3661 - RNA, 19 nt, Artificial Sequence
  siRNA Antisense Sequence
augaguuauucugggacga

SEQ ID NO: 3662 - RNA, 19 nt, Artificial Sequence
  siRNA Sense Sequence
cgucccagaauaacucauc

SEQ ID NO: 3663 - RNA, 19 nt, Artificial Sequence
  siRNA Antisense Sequence
gaugaguuauucugggacg

SEQ ID NO: 3664 - RNA, 19 nt, Artificial Sequence
  siRNA Sense Sequence
gucccagaauaacucaucc

SEQ ID NO: 3665 - RNA, 19 nt, Artificial Sequence
  siRNA Antisense Sequence
ggaugaguuauucugggac

SEQ ID NO: 3666 - RNA, 19 nt, Artificial Sequence
  siRNA Sense Sequence
ucccagaauaacucauccu

SEQ ID NO: 3667 - RNA, 19 nt, Artificial Sequence
  siRNA Antisense Sequence
aggaugaguuauucuggga

SEQ ID NO: 3668 - RNA, 19 nt, Artificial Sequence
  siRNA Sense Sequence
cccagaauaacucauccuc

SEQ ID NO: 3669 - RNA, 19 nt, Artificial Sequence
  siRNA Antisense Sequence
gaggaugaguuauucuggg

SEQ ID NO: 3670 - RNA, 19 nt, Artificial Sequence
  siRNA Sense Sequence
gacuacagccagggagugu

SEQ ID NO: 3671 - RNA, 19 nt, Artificial Sequence
  siRNA Antisense Sequence
acacucccuggcuguaguc

SEQ ID NO: 3672 - RNA, 19 nt, Artificial Sequence
  siRNA Sense Sequence
acuacagccagggagugug

SEQ ID NO: 3673 - RNA, 19 nt, Artificial Sequence
  siRNA Antisense Sequence
cacacucccuggcuguagu

SEQ ID NO: 3674 - RNA, 19 nt, Artificial Sequence
  siRNA Sense Sequence
cuacagccagggagugugg

SEQ ID NO: 3675 - RNA, 19 nt, Artificial Sequence
  siRNA Antisense Sequence
ccacacucccuggcuguag

SEQ ID NO: 3676 - RNA, 19 nt, Artificial Sequence
  siRNA Sense Sequence
gaguguggcuccagggaau

SEQ ID NO: 3677 - RNA, 19 nt, Artificial Sequence
  siRNA Antisense Sequence
auucccuggagccacacuc

SEQ ID NO: 3678 - RNA, 19 nt, Artificial Sequence
  siRNA Sense Sequence
gggaggaggucaucagcuu

SEQ ID NO: 3679 - RNA, 19 nt, Artificial Sequence
  siRNA Antisense Sequence
aagcugaugaccuccuccc

SEQ ID NO: 3680 - RNA, 19 nt, Artificial Sequence
  siRNA Sense Sequence
gaggucaucagcuuugcua

SEQ ID NO: 3681 - RNA, 19 nt, Artificial Sequence
  siRNA Antisense Sequence
uagcaaagcugaugaccuc

SEQ ID NO: 3682 - RNA, 19 nt, Artificial Sequence
  siRNA Sense Sequence
aggucaucagcuuugcuac

SEQ ID NO: 3683 - RNA, 19 nt, Artificial Sequence
  siRNA Antisense Sequence
guagcaaagcugaugaccu

SEQ ID NO: 3684 - RNA, 19 nt, Artificial Sequence
  siRNA Sense Sequence
ggucaucagcuuugcuacu

SEQ ID NO: 3685 - RNA, 19 nt, Artificial Sequence
  siRNA Antisense Sequence
aguagcaaagcugaugacc

SEQ ID NO: 3686 - RNA, 19 nt, Artificial Sequence
  siRNA Sense Sequence
gcuuugcuacugucacagg

SEQ ID NO: 3687 - RNA, 19 nt, Artificial Sequence
  siRNA Antisense Sequence
ccugugacaguagcaaagc

SEQ ID NO: 3688 - RNA, 19 nt, Artificial Sequence
  siRNA Sense Sequence
cuuugcuacugucacaggu

SEQ ID NO: 3689 - RNA, 19 nt, Artificial Sequence
  siRNA Antisense Sequence
accugugacaguagcaaag

SEQ ID NO: 3690 - RNA, 19 nt, Artificial Sequence
  siRNA Sense Sequence
uuugcuacugucacaggug

SEQ ID NO: 3691 - RNA, 19 nt, Artificial Sequence
  siRNA Antisense Sequence
caccugugacaguagcaaa

SEQ ID NO: 3692 - RNA, 19 nt, Artificial Sequence
  siRNA Sense Sequence
uugcuacugucacaggugg

SEQ ID NO: 3693 - RNA, 19 nt, Artificial Sequence
  siRNA Antisense Sequence
ccaccugugacaguagcaa

SEQ ID NO: 3694 - RNA, 19 nt, Artificial Sequence
  siRNA Sense Sequence
ugcuacugucacagguggg

SEQ ID NO: 3695 - RNA, 19 nt, Artificial Sequence
  siRNA Antisense Sequence
cccaccugugacaguagca

SEQ ID NO: 3696 - RNA, 19 nt, Artificial Sequence
  siRNA Sense Sequence
gcuacugucacaggugggu

SEQ ID NO: 3697 - RNA, 19 nt, Artificial Sequence
  siRNA Antisense Sequence
acccaccugugacaguagc

SEQ ID NO: 3698 - RNA, 19 nt, Artificial Sequence
  siRNA Sense Sequence
cuacugucacaggugggug

SEQ ID NO: 3699 - RNA, 19 nt, Artificial Sequence
  siRNA Antisense Sequence
cacccaccugugacaguag

SEQ ID NO: 3700 - RNA, 19 nt, Artificial Sequence
  siRNA Sense Sequence
caggcaaagagcagacagg

SEQ ID NO: 3701 - RNA, 19 nt, Artificial Sequence
  siRNA Antisense Sequence
ccugucugcucuuugccug

SEQ ID NO: 3702 - RNA, 19 nt, Artificial Sequence
  siRNA Sense Sequence
ggcagggacugguugcaga

SEQ ID NO: 3703 - RNA, 19 nt, Artificial Sequence
  siRNA Antisense Sequence
ucugcaaccagucccugcc

SEQ ID NO: 3704 - RNA, 19 nt, Artificial Sequence
  siRNA Sense Sequence
gcagggacugguugcagag

SEQ ID NO: 3705 - RNA, 19 nt, Artificial Sequence
  siRNA Antisense Sequence
cucugcaaccagucccugc

SEQ ID NO: 3706 - RNA, 19 nt, Artificial Sequence
  siRNA Sense Sequence
agggacugguugcagagga

SEQ ID NO: 3707 - RNA, 19 nt, Artificial Sequence
  siRNA Antisense Sequence
uccucugcaaccagucccu

SEQ ID NO: 3708 - RNA, 19 nt, Artificial Sequence
  siRNA Sense Sequence
gggacugguugcagaggac

SEQ ID NO: 3709 - RNA, 19 nt, Artificial Sequence
  siRNA Antisense Sequence
guccucugcaaccaguccc

SEQ ID NO: 3710 - RNA, 19 nt, Artificial Sequence
  siRNA Sense Sequence
ggacugguugcagaggaca

SEQ ID NO: 3711 - RNA, 19 nt, Artificial Sequence
  siRNA Antisense Sequence
uguccucugcaaccagucc

SEQ ID NO: 3712 - RNA, 19 nt, Artificial Sequence
  siRNA Sense Sequence
gacugguugcagaggacac

SEQ ID NO: 3713 - RNA, 19 nt, Artificial Sequence
  siRNA Antisense Sequence
guguccucugcaaccaguc

SEQ ID NO: 3714 - RNA, 19 nt, Artificial Sequence
  siRNA Sense Sequence
uuuucuagagguagguucg

SEQ ID NO: 3715 - RNA, 19 nt, Artificial Sequence
  siRNA Antisense Sequence
cgaaccuaccucuagaaaa

SEQ ID NO: 3716 - RNA, 19 nt, Artificial Sequence
  siRNA Sense Sequence
uuucuagagguagguucga

SEQ ID NO: 3717 - RNA, 19 nt, Artificial Sequence
  siRNA Antisense Sequence
ucgaaccuaccucuagaaa

SEQ ID NO: 3718 - RNA, 19 nt, Artificial Sequence
  siRNA Sense Sequence
uucuagagguagguucgag

SEQ ID NO: 3719 - RNA, 19 nt, Artificial Sequence
  siRNA Antisense Sequence
cucgaaccuaccucuagaa

SEQ ID NO: 3720 - RNA, 19 nt, Artificial Sequence
  siRNA Sense Sequence
ucuagagguagguucgagg

SEQ ID NO: 3721 - RNA, 19 nt, Artificial Sequence
  siRNA Antisense Sequence
ccucgaaccuaccucuaga

SEQ ID NO: 3722 - RNA, 19 nt, Artificial Sequence
  siRNA Sense Sequence
cuagagguagguucgaggg

SEQ ID NO: 3723 - RNA, 19 nt, Artificial Sequence
  siRNA Antisense Sequence
cccucgaaccuaccucuag

SEQ ID NO: 3724 - RNA, 19 nt, Artificial Sequence
  siRNA Sense Sequence
uagagguagguucgaggga

SEQ ID NO: 3725 - RNA, 19 nt, Artificial Sequence
  siRNA Antisense Sequence
ucccucgaaccuaccucua

SEQ ID NO: 3726 - RNA, 19 nt, Artificial Sequence
  siRNA Sense Sequence
gagcuucaucucuacucac

SEQ ID NO: 3727 - RNA, 19 nt, Artificial Sequence
  siRNA Antisense Sequence
gugaguagagaugaagcuc

SEQ ID NO: 3728 - RNA, 19 nt, Artificial Sequence
  siRNA Sense Sequence
agcuucaucucuacucaca

SEQ ID NO: 3729 - RNA, 19 nt, Artificial Sequence
  siRNA Antisense Sequence
ugugaguagagaugaagcu

SEQ ID NO: 3730 - RNA, 19 nt, Artificial Sequence
  siRNA Sense Sequence
gcuucaucucuacucacau

SEQ ID NO: 3731 - RNA, 19 nt, Artificial Sequence
  siRNA Antisense Sequence
augugaguagagaugaagc

SEQ ID NO: 3732 - RNA, 19 nt, Artificial Sequence
  siRNA Sense Sequence
cuucaucucuacucacauu

SEQ ID NO: 3733 - RNA, 19 nt, Artificial Sequence
  siRNA Antisense Sequence
aaugugaguagagaugaag

SEQ ID NO: 3734 - RNA, 19 nt, Artificial Sequence
  siRNA Sense Sequence
aucucuacucacauuuucu

SEQ ID NO: 3735 - RNA, 19 nt, Artificial Sequence
  siRNA Antisense Sequence
agaaaaugugaguagagau

SEQ ID NO: 3736 - RNA, 19 nt, Artificial Sequence
  siRNA Sense Sequence
ucucuacucacauuuucuu

SEQ ID NO: 3737 - RNA, 19 nt, Artificial Sequence
  siRNA Antisense Sequence
aagaaaaugugaguagaga

SEQ ID NO: 3738 - RNA, 19 nt, Artificial Sequence
  siRNA Sense Sequence
ucacauuuucuuucccuuu

SEQ ID NO: 3739 - RNA, 19 nt, Artificial Sequence
  siRNA Antisense Sequence
aaagggaaagaaaauguga

SEQ ID NO: 3740 - RNA, 19 nt, Artificial Sequence
  siRNA Sense Sequence
cccuuuucugucuuucggg

SEQ ID NO: 3741 - RNA, 19 nt, Artificial Sequence
  siRNA Antisense Sequence
cccgaaagacagaaaaggg

SEQ ID NO: 3742 - RNA, 19 nt, Artificial Sequence
  siRNA Sense Sequence
ccuuuucugucuuucgggc

SEQ ID NO: 3743 - RNA, 19 nt, Artificial Sequence
  siRNA Antisense Sequence
gcccgaaagacagaaaagg

SEQ ID NO: 3744 - RNA, 19 nt, Artificial Sequence
  siRNA Sense Sequence
cuuuucugucuuucgggca

SEQ ID NO: 3745 - RNA, 19 nt, Artificial Sequence
  siRNA Antisense Sequence
ugcccgaaagacagaaaag

SEQ ID NO: 3746 - RNA, 19 nt, Artificial Sequence
  siRNA Sense Sequence
uuucgggcagacuccacuu

SEQ ID NO: 3747 - RNA, 19 nt, Artificial Sequence
  siRNA Antisense Sequence
aaguggagucugcccgaaa

SEQ ID NO: 3748 - RNA, 19 nt, Artificial Sequence
  siRNA Sense Sequence
uucgggcagacuccacuuc

SEQ ID NO: 3749 - RNA, 19 nt, Artificial Sequence
  siRNA Antisense Sequence
gaaguggagucugcccgaa

SEQ ID NO: 3750 - RNA, 19 nt, Artificial Sequence
  siRNA Sense Sequence
ucgggcagacuccacuuca

SEQ ID NO: 3751 - RNA, 19 nt, Artificial Sequence
  siRNA Antisense Sequence
ugaaguggagucugcccga

SEQ ID NO: 3752 - RNA, 19 nt, Artificial Sequence
  siRNA Sense Sequence
cgggcagacuccacuucag

SEQ ID NO: 3753 - RNA, 19 nt, Artificial Sequence
  siRNA Antisense Sequence
cugaaguggagucugcccg

SEQ ID NO: 3754 - RNA, 19 nt, Artificial Sequence
  siRNA Sense Sequence
gggcagacuccacuucagc

SEQ ID NO: 3755 - RNA, 19 nt, Artificial Sequence
  siRNA Antisense Sequence
gcugaaguggagucugccc

SEQ ID NO: 3756 - RNA, 19 nt, Artificial Sequence
  siRNA Sense Sequence
ggcagacuccacuucagcc

SEQ ID NO: 3757 - RNA, 19 nt, Artificial Sequence
  siRNA Antisense Sequence
ggcugaaguggagucugcc

SEQ ID NO: 3758 - RNA, 19 nt, Artificial Sequence
  siRNA Sense Sequence
uccacuucagccuacagcu

SEQ ID NO: 3759 - RNA, 19 nt, Artificial Sequence
  siRNA Antisense Sequence
agcuguaggcugaagugga

SEQ ID NO: 3760 - RNA, 19 nt, Artificial Sequence
  siRNA Sense Sequence
ccacuucagccuacagcuc

SEQ ID NO: 3761 - RNA, 19 nt, Artificial Sequence
  siRNA Antisense Sequence
gagcuguaggcugaagugg

SEQ ID NO: 3762 - RNA, 19 nt, Artificial Sequence
  siRNA Sense Sequence
cacuucagccuacagcucc

SEQ ID NO: 3763 - RNA, 19 nt, Artificial Sequence
  siRNA Antisense Sequence
ggagcuguaggcugaagug

SEQ ID NO: 3764 - RNA, 19 nt, Artificial Sequence
  siRNA Sense Sequence
acuucagccuacagcuccc

SEQ ID NO: 3765 - RNA, 19 nt, Artificial Sequence
  siRNA Antisense Sequence
gggagcuguaggcugaagu

SEQ ID NO: 3766 - RNA, 19 nt, Artificial Sequence
  siRNA Sense Sequence
ccuacagcucccugcucac

SEQ ID NO: 3767 - RNA, 19 nt, Artificial Sequence
  siRNA Antisense Sequence
gugagcagggagcuguagg

SEQ ID NO: 3768 - RNA, 19 nt, Artificial Sequence
  siRNA Sense Sequence
cuacagcucccugcucacu

SEQ ID NO: 3769 - RNA, 19 nt, Artificial Sequence
  siRNA Antisense Sequence
agugagcagggagcuguag

SEQ ID NO: 3770 - RNA, 19 nt, Artificial Sequence
  siRNA Sense Sequence
uacagcucccugcucacuu

SEQ ID NO: 3771 - RNA, 19 nt, Artificial Sequence
  siRNA Antisense Sequence
aagugagcagggagcugua

SEQ ID NO: 3772 - RNA, 19 nt, Artificial Sequence
  siRNA Sense Sequence
gcucccugcucacuuuuca

SEQ ID NO: 3773 - RNA, 19 nt, Artificial Sequence
  siRNA Antisense Sequence
ugaaaagugagcagggagc

SEQ ID NO: 3774 - RNA, 19 nt, Artificial Sequence
  siRNA Sense Sequence
cucccugcucacuuuucac

SEQ ID NO: 3775 - RNA, 19 nt, Artificial Sequence
  siRNA Antisense Sequence
gugaaaagugagcagggag

SEQ ID NO: 3776 - RNA, 19 nt, Artificial Sequence
  siRNA Sense Sequence
gcucacuuuucaccugucc

SEQ ID NO: 3777 - RNA, 19 nt, Artificial Sequence
  siRNA Antisense Sequence
ggacaggugaaaagugagc

SEQ ID NO: 3778 - RNA, 19 nt, Artificial Sequence
  siRNA Sense Sequence
cucacuuuucaccugucca

SEQ ID NO: 3779 - RNA, 19 nt, Artificial Sequence
  siRNA Antisense Sequence
uggacaggugaaaagugag

SEQ ID NO: 3780 - RNA, 19 nt, Artificial Sequence
  siRNA Sense Sequence
uguccacuccucgguccca

SEQ ID NO: 3781 - RNA, 19 nt, Artificial Sequence
  siRNA Antisense Sequence
ugggaccgaggaguggaca

SEQ ID NO: 3782 - RNA, 19 nt, Artificial Sequence
  siRNA Sense Sequence
ucggucccaccaccuguac

SEQ ID NO: 3783 - RNA, 19 nt, Artificial Sequence
  siRNA Antisense Sequence
guacagguggugggaccga

SEQ ID NO: 3784 - RNA, 19 nt, Artificial Sequence
  siRNA Sense Sequence
ccaccaccuguaccaugcc

SEQ ID NO: 3785 - RNA, 19 nt, Artificial Sequence
  siRNA Antisense Sequence
ggcaugguacagguggugg

SEQ ID NO: 3786 - RNA, 19 nt, Artificial Sequence
  siRNA Sense Sequence
caccaccuguaccaugccc

SEQ ID NO: 3787 - RNA, 19 nt, Artificial Sequence
  siRNA Antisense Sequence
gggcaugguacagguggug

SEQ ID NO: 3788 - RNA, 19 nt, Artificial Sequence
  siRNA Sense Sequence
accaccuguaccaugcccg

SEQ ID NO: 3789 - RNA, 19 nt, Artificial Sequence
  siRNA Antisense Sequence
cgggcaugguacagguggu

SEQ ID NO: 3790 - RNA, 19 nt, Artificial Sequence
  siRNA Sense Sequence
cacccuuccuggcacucuu

SEQ ID NO: 3791 - RNA, 19 nt, Artificial Sequence
  siRNA Antisense Sequence
aagagugccaggaagggug

SEQ ID NO: 3792 - RNA, 19 nt, Artificial Sequence
  siRNA Sense Sequence
acccuuccuggcacucuuu

SEQ ID NO: 3793 - RNA, 19 nt, Artificial Sequence
  siRNA Antisense Sequence
aaagagugccaggaagggu

SEQ ID NO: 3794 - RNA, 19 nt, Artificial Sequence
  siRNA Sense Sequence
cccuuccuggcacucuuug

SEQ ID NO: 3795 - RNA, 19 nt, Artificial Sequence
  siRNA Antisense Sequence
caaagagugccaggaaggg

SEQ ID NO: 3796 - RNA, 19 nt, Artificial Sequence
  siRNA Sense Sequence
ccuuccuggcacucuuugc

SEQ ID NO: 3797 - RNA, 19 nt, Artificial Sequence
  siRNA Antisense Sequence
gcaaagagugccaggaagg

SEQ ID NO: 3798 - RNA, 19 nt, Artificial Sequence
  siRNA Sense Sequence
uuccuggcacucuuugcuu

SEQ ID NO: 3799 - RNA, 19 nt, Artificial Sequence
  siRNA Antisense Sequence
aagcaaagagugccaggaa

SEQ ID NO: 3800 - RNA, 19 nt, Artificial Sequence
  siRNA Sense Sequence
uccuggcacucuuugcuug

SEQ ID NO: 3801 - RNA, 19 nt, Artificial Sequence
  siRNA Antisense Sequence
caagcaaagagugccagga

SEQ ID NO: 3802 - RNA, 19 nt, Artificial Sequence
  siRNA Sense Sequence
ccuggcacucuuugcuuga

SEQ ID NO: 3803 - RNA, 19 nt, Artificial Sequence
  siRNA Antisense Sequence
ucaagcaaagagugccagg

SEQ ID NO: 3804 - RNA, 19 nt, Artificial Sequence
  siRNA Sense Sequence
cuggcacucuuugcuugag

SEQ ID NO: 3805 - RNA, 19 nt, Artificial Sequence
  siRNA Antisense Sequence
cucaagcaaagagugccag

SEQ ID NO: 3806 - RNA, 19 nt, Artificial Sequence
  siRNA Sense Sequence
uggcacucuuugcuugagg

SEQ ID NO: 3807 - RNA, 19 nt, Artificial Sequence
  siRNA Antisense Sequence
ccucaagcaaagagugcca

SEQ ID NO: 3808 - RNA, 19 nt, Artificial Sequence
  siRNA Sense Sequence
ggcacucuuugcuugagga

SEQ ID NO: 3809 - RNA, 19 nt, Artificial Sequence
  siRNA Antisense Sequence
uccucaagcaaagagugcc

SEQ ID NO: 3810 - RNA, 19 nt, Artificial Sequence
  siRNA Sense Sequence
gcacucuuugcuugaggau

SEQ ID NO: 3811 - RNA, 19 nt, Artificial Sequence
  siRNA Antisense Sequence
auccucaagcaaagagugc

SEQ ID NO: 3812 - RNA, 19 nt, Artificial Sequence
  siRNA Sense Sequence
cacucuuugcuugaggauc

SEQ ID NO: 3813 - RNA, 19 nt, Artificial Sequence
  siRNA Antisense Sequence
gauccucaagcaaagagug

SEQ ID NO: 3814 - RNA, 19 nt, Artificial Sequence
  siRNA Sense Sequence
acucuuugcuugaggaucu

SEQ ID NO: 3815 - RNA, 19 nt, Artificial Sequence
  siRNA Antisense Sequence
agauccucaagcaaagagu

SEQ ID NO: 3816 - RNA, 19 nt, Artificial Sequence
  siRNA Sense Sequence
cucuuugcuugaggaucuu

SEQ ID NO: 3817 - RNA, 19 nt, Artificial Sequence
  siRNA Antisense Sequence
aagauccucaagcaaagag

SEQ ID NO: 3818 - RNA, 19 nt, Artificial Sequence
  siRNA Sense Sequence
ucuuugcuugaggaucuuc

SEQ ID NO: 3819 - RNA, 19 nt, Artificial Sequence
  siRNA Antisense Sequence
gaagauccucaagcaaaga

SEQ ID NO: 3820 - RNA, 19 nt, Artificial Sequence
  siRNA Sense Sequence
ugcuugaggaucuuccgau

SEQ ID NO: 3821 - RNA, 19 nt, Artificial Sequence
  siRNA Antisense Sequence
aucggaagauccucaagca

SEQ ID NO: 3822 - RNA, 19 nt, Artificial Sequence
  siRNA Sense Sequence
gcuugaggaucuuccgaug

SEQ ID NO: 3823 - RNA, 19 nt, Artificial Sequence
  siRNA Antisense Sequence
caucggaagauccucaagc

SEQ ID NO: 3824 - RNA, 19 nt, Artificial Sequence
  siRNA Sense Sequence
gcacucuccuggcugagca

SEQ ID NO: 3825 - RNA, 19 nt, Artificial Sequence
  siRNA Antisense Sequence
ugcucagccaggagagugc

SEQ ID NO: 3826 - RNA, 19 nt, Artificial Sequence
  siRNA Sense Sequence
cuccuggcugagcaccaca

SEQ ID NO: 3827 - RNA, 19 nt, Artificial Sequence
  siRNA Antisense Sequence
uguggugcucagccaggag

SEQ ID NO: 3828 - RNA, 19 nt, Artificial Sequence
  siRNA Sense Sequence
uggcugagcaccacaucac

SEQ ID NO: 3829 - RNA, 19 nt, Artificial Sequence
  siRNA Antisense Sequence
gugauguggugcucagcca

SEQ ID NO: 3830 - RNA, 19 nt, Artificial Sequence
  siRNA Sense Sequence
ggcugagcaccacaucacc

SEQ ID NO: 3831 - RNA, 19 nt, Artificial Sequence
  siRNA Antisense Sequence
ggugauguggugcucagcc

SEQ ID NO: 3832 - RNA, 19 nt, Artificial Sequence
  siRNA Sense Sequence
gcugagcaccacaucacca

SEQ ID NO: 3833 - RNA, 19 nt, Artificial Sequence
  siRNA Antisense Sequence
uggugauguggugcucagc

SEQ ID NO: 3834 - RNA, 19 nt, Artificial Sequence
  siRNA Sense Sequence
cugagcaccacaucaccaa

SEQ ID NO: 3835 - RNA, 19 nt, Artificial Sequence
  siRNA Antisense Sequence
uuggugauguggugcucag

SEQ ID NO: 3836 - RNA, 19 nt, Artificial Sequence
  siRNA Sense Sequence
ccaaccugggcuggcauac

SEQ ID NO: 3837 - RNA, 19 nt, Artificial Sequence
  siRNA Antisense Sequence
guaugccagcccagguugg

SEQ ID NO: 3838 - RNA, 19 nt, Artificial Sequence
  siRNA Sense Sequence
caaccugggcuggcauacc

SEQ ID NO: 3839 - RNA, 19 nt, Artificial Sequence
  siRNA Antisense Sequence
gguaugccagcccagguug

SEQ ID NO: 3840 - RNA, 19 nt, Artificial Sequence
  siRNA Sense Sequence
aaccugggcuggcauaccu

SEQ ID NO: 3841 - RNA, 19 nt, Artificial Sequence
  siRNA Antisense Sequence
agguaugccagcccagguu

SEQ ID NO: 3842 - RNA, 19 nt, Artificial Sequence
  siRNA Sense Sequence
accugggcuggcauaccuu

SEQ ID NO: 3843 - RNA, 19 nt, Artificial Sequence
  siRNA Antisense Sequence
aagguaugccagcccaggu

SEQ ID NO: 3844 - RNA, 19 nt, Artificial Sequence
  siRNA Sense Sequence
ccugggcuggcauaccuua

SEQ ID NO: 3845 - RNA, 19 nt, Artificial Sequence
  siRNA Antisense Sequence
uaagguaugccagcccagg

SEQ ID NO: 3846 - RNA, 19 nt, Artificial Sequence
  siRNA Sense Sequence
cugggcuggcauaccuuaa

SEQ ID NO: 3847 - RNA, 19 nt, Artificial Sequence
  siRNA Antisense Sequence
uuaagguaugccagcccag

SEQ ID NO: 3848 - RNA, 19 nt, Artificial Sequence
  siRNA Sense Sequence
ugggcuggcauaccuuaac

SEQ ID NO: 3849 - RNA, 19 nt, Artificial Sequence
  siRNA Antisense Sequence
guuaagguaugccagccca

SEQ ID NO: 3850 - RNA, 19 nt, Artificial Sequence
  siRNA Sense Sequence
gggcuggcauaccuuaacu

SEQ ID NO: 3851 - RNA, 19 nt, Artificial Sequence
  siRNA Antisense Sequence
aguuaagguaugccagccc

SEQ ID NO: 3852 - RNA, 19 nt, Artificial Sequence
  siRNA Sense Sequence
ggcuggcauaccuuaacuc

SEQ ID NO: 3853 - RNA, 19 nt, Artificial Sequence
  siRNA Antisense Sequence
gaguuaagguaugccagcc

SEQ ID NO: 3854 - RNA, 19 nt, Artificial Sequence
  siRNA Sense Sequence
gcuggcauaccuuaacucu

SEQ ID NO: 3855 - RNA, 19 nt, Artificial Sequence
  siRNA Antisense Sequence
agaguuaagguaugccagc

SEQ ID NO: 3856 - RNA, 19 nt, Artificial Sequence
  siRNA Sense Sequence
cauaccuuaacucugcccu

SEQ ID NO: 3857 - RNA, 19 nt, Artificial Sequence
  siRNA Antisense Sequence
agggcagaguuaagguaug

SEQ ID NO: 3858 - RNA, 19 nt, Artificial Sequence
  siRNA Sense Sequence
auaccuuaacucugcccuc

SEQ ID NO: 3859 - RNA, 19 nt, Artificial Sequence
  siRNA Antisense Sequence
gagggcagaguuaagguau

SEQ ID NO: 3860 - RNA, 19 nt, Artificial Sequence
  siRNA Sense Sequence
uaccuuaacucugcccucu

SEQ ID NO: 3861 - RNA, 19 nt, Artificial Sequence
  siRNA Antisense Sequence
agagggcagaguuaaggua

SEQ ID NO: 3862 - RNA, 19 nt, Artificial Sequence
  siRNA Sense Sequence
ucugcccucuaguggcuug

SEQ ID NO: 3863 - RNA, 19 nt, Artificial Sequence
  siRNA Antisense Sequence
caagccacuagagggcaga

SEQ ID NO: 3864 - RNA, 19 nt, Artificial Sequence
  siRNA Sense Sequence
cugcccucuaguggcuuga

SEQ ID NO: 3865 - RNA, 19 nt, Artificial Sequence
  siRNA Antisense Sequence
ucaagccacuagagggcag

SEQ ID NO: 3866 - RNA, 19 nt, Artificial Sequence
  siRNA Sense Sequence
ugcccucuaguggcuugag

SEQ ID NO: 3867 - RNA, 19 nt, Artificial Sequence
  siRNA Antisense Sequence
cucaagccacuagagggca

SEQ ID NO: 3868 - RNA, 19 nt, Artificial Sequence
  siRNA Sense Sequence
agaagucugguguccugaa

SEQ ID NO: 3869 - RNA, 19 nt, Artificial Sequence
  siRNA Antisense Sequence
uucaggacaccagacuucu

SEQ ID NO: 3870 - RNA, 19 nt, Artificial Sequence
  siRNA Sense Sequence
caggacaccagcagcccuu

SEQ ID NO: 3871 - RNA, 19 nt, Artificial Sequence
  siRNA Antisense Sequence
aagggcugcugguguccug

SEQ ID NO: 3872 - RNA, 19 nt, Artificial Sequence
  siRNA Sense Sequence
aggacaccagcagcccuuc

SEQ ID NO: 3873 - RNA, 19 nt, Artificial Sequence
  siRNA Antisense Sequence
gaagggcugcugguguccu

SEQ ID NO: 3874 - RNA, 19 nt, Artificial Sequence
  siRNA Sense Sequence
acaccagcagcccuuccua

SEQ ID NO: 3875 - RNA, 19 nt, Artificial Sequence
  siRNA Antisense Sequence
uaggaagggcugcuggugu

SEQ ID NO: 3876 - RNA, 19 nt, Artificial Sequence
  siRNA Sense Sequence
caccagcagcccuuccuag

SEQ ID NO: 3877 - RNA, 19 nt, Artificial Sequence
  siRNA Antisense Sequence
cuaggaagggcugcuggug

SEQ ID NO: 3878 - RNA, 19 nt, Artificial Sequence
  siRNA Sense Sequence
accagcagcccuuccuaga

SEQ ID NO: 3879 - RNA, 19 nt, Artificial Sequence
  siRNA Antisense Sequence
ucuaggaagggcugcuggu

SEQ ID NO: 3880 - RNA, 19 nt, Artificial Sequence
  siRNA Sense Sequence
ccagcagcccuuccuagag

SEQ ID NO: 3881 - RNA, 19 nt, Artificial Sequence
  siRNA Antisense Sequence
cucuaggaagggcugcugg

SEQ ID NO: 3882 - RNA, 19 nt, Artificial Sequence
  siRNA Sense Sequence
cagcagcccuuccuagagc

SEQ ID NO: 3883 - RNA, 19 nt, Artificial Sequence
  siRNA Antisense Sequence
gcucuaggaagggcugcug

SEQ ID NO: 3884 - RNA, 19 nt, Artificial Sequence
  siRNA Sense Sequence
agcagcccuuccuagagcu

SEQ ID NO: 3885 - RNA, 19 nt, Artificial Sequence
  siRNA Antisense Sequence
agcucuaggaagggcugcu

SEQ ID NO: 3886 - RNA, 19 nt, Artificial Sequence
  siRNA Sense Sequence
gcccuuccuagagcuuaag

SEQ ID NO: 3887 - RNA, 19 nt, Artificial Sequence
  siRNA Antisense Sequence
cuuaagcucuaggaagggc

SEQ ID NO: 3888 - RNA, 19 nt, Artificial Sequence
  siRNA Sense Sequence
cccuuccuagagcuuaaga

SEQ ID NO: 3889 - RNA, 19 nt, Artificial Sequence
  siRNA Antisense Sequence
ucuuaagcucuaggaaggg

SEQ ID NO: 3890 - RNA, 19 nt, Artificial Sequence
  siRNA Sense Sequence
agcuuaagauccgagccaa

SEQ ID NO: 3891 - RNA, 19 nt, Artificial Sequence
  siRNA Antisense Sequence
uuggcucggaucuuaagcu

SEQ ID NO: 3892 - RNA, 19 nt, Artificial Sequence
  siRNA Sense Sequence
gcuuaagauccgagccaau

SEQ ID NO: 3893 - RNA, 19 nt, Artificial Sequence
  siRNA Antisense Sequence
auuggcucggaucuuaagc

SEQ ID NO: 3894 - RNA, 19 nt, Artificial Sequence
  siRNA Sense Sequence
cuuaagauccgagccaaug

SEQ ID NO: 3895 - RNA, 19 nt, Artificial Sequence
  siRNA Antisense Sequence
cauuggcucggaucuuaag

SEQ ID NO: 3896 - RNA, 19 nt, Artificial Sequence
  siRNA Sense Sequence
uuaagauccgagccaauga

SEQ ID NO: 3897 - RNA, 19 nt, Artificial Sequence
  siRNA Antisense Sequence
ucauuggcucggaucuuaa

SEQ ID NO: 3898 - RNA, 19 nt, Artificial Sequence
  siRNA Sense Sequence
uaagauccgagccaaugag

SEQ ID NO: 3899 - RNA, 19 nt, Artificial Sequence
  siRNA Antisense Sequence
cucauuggcucggaucuua

SEQ ID NO: 3900 - RNA, 19 nt, Artificial Sequence
  siRNA Sense Sequence
cgagccaaugagccuggag

SEQ ID NO: 3901 - RNA, 19 nt, Artificial Sequence
  siRNA Antisense Sequence
cuccaggcucauuggcucg

SEQ ID NO: 3902 - RNA, 19 nt, Artificial Sequence
  siRNA Sense Sequence
cccuuauguugcaggcgag

SEQ ID NO: 3903 - RNA, 19 nt, Artificial Sequence
  siRNA Antisense Sequence
cucgccugcaacauaaggg

SEQ ID NO: 3904 - RNA, 19 nt, Artificial Sequence
  siRNA Sense Sequence
cauuacguagacuuccagg

SEQ ID NO: 3905 - RNA, 19 nt, Artificial Sequence
  siRNA Antisense Sequence
ccuggaagucuacguaaug

SEQ ID NO: 3906 - RNA, 19 nt, Artificial Sequence
  siRNA Sense Sequence
auuacguagacuuccagga

SEQ ID NO: 3907 - RNA, 19 nt, Artificial Sequence
  siRNA Antisense Sequence
uccuggaagucuacguaau

SEQ ID NO: 3908 - RNA, 19 nt, Artificial Sequence
  siRNA Sense Sequence
uuacguagacuuccaggaa

SEQ ID NO: 3909 - RNA, 19 nt, Artificial Sequence
  siRNA Antisense Sequence
uuccuggaagucuacguaa

SEQ ID NO: 3910 - RNA, 19 nt, Artificial Sequence
  siRNA Sense Sequence
acuggauacugcagcccga

SEQ ID NO: 3911 - RNA, 19 nt, Artificial Sequence
  siRNA Antisense Sequence
ucgggcugcaguauccagu

SEQ ID NO: 3912 - RNA, 19 nt, Artificial Sequence
  siRNA Sense Sequence
cuggauacugcagcccgag

SEQ ID NO: 3913 - RNA, 19 nt, Artificial Sequence
  siRNA Antisense Sequence
cucgggcugcaguauccag

SEQ ID NO: 3914 - RNA, 19 nt, Artificial Sequence
  siRNA Sense Sequence
uggauacugcagcccgagg

SEQ ID NO: 3915 - RNA, 19 nt, Artificial Sequence
  siRNA Antisense Sequence
ccucgggcugcaguaucca

SEQ ID NO: 3916 - RNA, 19 nt, Artificial Sequence
  siRNA Sense Sequence
ggguaccagcugaauuacu

SEQ ID NO: 3917 - RNA, 19 nt, Artificial Sequence
  siRNA Antisense Sequence
aguaauucagcugguaccc

SEQ ID NO: 3918 - RNA, 19 nt, Artificial Sequence
  siRNA Sense Sequence
cugaauuacugcagugggc

SEQ ID NO: 3919 - RNA, 19 nt, Artificial Sequence
  siRNA Antisense Sequence
gcccacugcaguaauucag

SEQ ID NO: 3920 - RNA, 19 nt, Artificial Sequence
  siRNA Sense Sequence
ugaauuacugcagugggca

SEQ ID NO: 3921 - RNA, 19 nt, Artificial Sequence
  siRNA Antisense Sequence
ugcccacugcaguaauuca

SEQ ID NO: 3922 - RNA, 19 nt, Artificial Sequence
  siRNA Sense Sequence
uggcagcccaggcauugcu

SEQ ID NO: 3923 - RNA, 19 nt, Artificial Sequence
  siRNA Antisense Sequence
agcaaugccugggcugcca

SEQ ID NO: 3924 - RNA, 19 nt, Artificial Sequence
  siRNA Sense Sequence
gcauugcugccucuuucca

SEQ ID NO: 3925 - RNA, 19 nt, Artificial Sequence
  siRNA Antisense Sequence
uggaaagaggcagcaaugc

SEQ ID NO: 3926 - RNA, 19 nt, Artificial Sequence
  siRNA Sense Sequence
cauugcugccucuuuccau

SEQ ID NO: 3927 - RNA, 19 nt, Artificial Sequence
  siRNA Antisense Sequence
auggaaagaggcagcaaug

SEQ ID NO: 3928 - RNA, 19 nt, Artificial Sequence
  siRNA Sense Sequence
auugcugccucuuuccauu

SEQ ID NO: 3929 - RNA, 19 nt, Artificial Sequence
  siRNA Antisense Sequence
aauggaaagaggcagcaau

SEQ ID NO: 3930 - RNA, 19 nt, Artificial Sequence
  siRNA Sense Sequence
ugcugccucuuuccauucu

SEQ ID NO: 3931 - RNA, 19 nt, Artificial Sequence
  siRNA Antisense Sequence
agaauggaaagaggcagca

SEQ ID NO: 3932 - RNA, 19 nt, Artificial Sequence
  siRNA Sense Sequence
gcugccucuuuccauucug

SEQ ID NO: 3933 - RNA, 19 nt, Artificial Sequence
  siRNA Antisense Sequence
cagaauggaaagaggcagc

SEQ ID NO: 3934 - RNA, 19 nt, Artificial Sequence
  siRNA Sense Sequence
cugccucuuuccauucugc

SEQ ID NO: 3935 - RNA, 19 nt, Artificial Sequence
  siRNA Antisense Sequence
gcagaauggaaagaggcag

SEQ ID NO: 3936 - RNA, 19 nt, Artificial Sequence
  siRNA Sense Sequence
ugccucuuuccauucugcc

SEQ ID NO: 3937 - RNA, 19 nt, Artificial Sequence
  siRNA Antisense Sequence
ggcagaauggaaagaggca

SEQ ID NO: 3938 - RNA, 19 nt, Artificial Sequence
  siRNA Sense Sequence
gccucuuuccauucugccg

SEQ ID NO: 3939 - RNA, 19 nt, Artificial Sequence
  siRNA Antisense Sequence
cggcagaauggaaagaggc

SEQ ID NO: 3940 - RNA, 19 nt, Artificial Sequence
  siRNA Sense Sequence
ccucuuuccauucugccgu

SEQ ID NO: 3941 - RNA, 19 nt, Artificial Sequence
  siRNA Antisense Sequence
acggcagaauggaaagagg

SEQ ID NO: 3942 - RNA, 19 nt, Artificial Sequence
  siRNA Sense Sequence
cucuuuccauucugccguc

SEQ ID NO: 3943 - RNA, 19 nt, Artificial Sequence
  siRNA Antisense Sequence
gacggcagaauggaaagag

SEQ ID NO: 3944 - RNA, 19 nt, Artificial Sequence
  siRNA Sense Sequence
cauucugccgucuucagcc

SEQ ID NO: 3945 - RNA, 19 nt, Artificial Sequence
  siRNA Antisense Sequence
ggcugaagacggcagaaug

SEQ ID NO: 3946 - RNA, 19 nt, Artificial Sequence
  siRNA Sense Sequence
cuucagccuccucaaagcc

SEQ ID NO: 3947 - RNA, 19 nt, Artificial Sequence
  siRNA Antisense Sequence
ggcuuugaggaggcugaag

SEQ ID NO: 3948 - RNA, 19 nt, Artificial Sequence
  siRNA Sense Sequence
uucagccuccucaaagcca

SEQ ID NO: 3949 - RNA, 19 nt, Artificial Sequence
  siRNA Antisense Sequence
uggcuuugaggaggcugaa

SEQ ID NO: 3950 - RNA, 19 nt, Artificial Sequence
  siRNA Sense Sequence
ucagccuccucaaagccaa

SEQ ID NO: 3951 - RNA, 19 nt, Artificial Sequence
  siRNA Antisense Sequence
uuggcuuugaggaggcuga

SEQ ID NO: 3952 - RNA, 19 nt, Artificial Sequence
  siRNA Sense Sequence
cagccuccucaaagccaac

SEQ ID NO: 3953 - RNA, 19 nt, Artificial Sequence
  siRNA Antisense Sequence
guuggcuuugaggaggcug

SEQ ID NO: 3954 - RNA, 19 nt, Artificial Sequence
  siRNA Sense Sequence
uccuuggccugccaguacc

SEQ ID NO: 3955 - RNA, 19 nt, Artificial Sequence
  siRNA Antisense Sequence
gguacuggcaggccaagga

SEQ ID NO: 3956 - RNA, 19 nt, Artificial Sequence
  siRNA Sense Sequence
ccugccaguaccuccuguu

SEQ ID NO: 3957 - RNA, 19 nt, Artificial Sequence
  siRNA Antisense Sequence
aacaggagguacuggcagg

SEQ ID NO: 3958 - RNA, 19 nt, Artificial Sequence
  siRNA Sense Sequence
cugccaguaccuccuguug

SEQ ID NO: 3959 - RNA, 19 nt, Artificial Sequence
  siRNA Antisense Sequence
caacaggagguacuggcag

SEQ ID NO: 3960 - RNA, 19 nt, Artificial Sequence
  siRNA Sense Sequence
ugccaguaccuccuguugu

SEQ ID NO: 3961 - RNA, 19 nt, Artificial Sequence
  siRNA Antisense Sequence
acaacaggagguacuggca

SEQ ID NO: 3962 - RNA, 19 nt, Artificial Sequence
  siRNA Sense Sequence
gccaguaccuccuguugug

SEQ ID NO: 3963 - RNA, 19 nt, Artificial Sequence
  siRNA Antisense Sequence
cacaacaggagguacuggc

SEQ ID NO: 3964 - RNA, 19 nt, Artificial Sequence
  siRNA Sense Sequence
ccaguaccuccuguugugu

SEQ ID NO: 3965 - RNA, 19 nt, Artificial Sequence
  siRNA Antisense Sequence
acacaacaggagguacugg

SEQ ID NO: 3966 - RNA, 19 nt, Artificial Sequence
  siRNA Sense Sequence
caguaccuccuguuguguc

SEQ ID NO: 3967 - RNA, 19 nt, Artificial Sequence
  siRNA Antisense Sequence
gacacaacaggagguacug

SEQ ID NO: 3968 - RNA, 19 nt, Artificial Sequence
  siRNA Sense Sequence
guaccuccuguuguguccc

SEQ ID NO: 3969 - RNA, 19 nt, Artificial Sequence
  siRNA Antisense Sequence
gggacacaacaggagguac

SEQ ID NO: 3970 - RNA, 19 nt, Artificial Sequence
  siRNA Sense Sequence
uaccuccuguugugucccu

SEQ ID NO: 3971 - RNA, 19 nt, Artificial Sequence
  siRNA Antisense Sequence
agggacacaacaggaggua

SEQ ID NO: 3972 - RNA, 19 nt, Artificial Sequence
  siRNA Sense Sequence
accuccuguugugucccua

SEQ ID NO: 3973 - RNA, 19 nt, Artificial Sequence
  siRNA Antisense Sequence
uagggacacaacaggaggu

SEQ ID NO: 3974 - RNA, 19 nt, Artificial Sequence
  siRNA Sense Sequence
ccuccuguugugucccuac

SEQ ID NO: 3975 - RNA, 19 nt, Artificial Sequence
  siRNA Antisense Sequence
guagggacacaacaggagg

SEQ ID NO: 3976 - RNA, 19 nt, Artificial Sequence
  siRNA Sense Sequence
cuccuguugugucccuacu

SEQ ID NO: 3977 - RNA, 19 nt, Artificial Sequence
  siRNA Antisense Sequence
aguagggacacaacaggag

SEQ ID NO: 3978 - RNA, 19 nt, Artificial Sequence
  siRNA Sense Sequence
uugugucccuacugcccga

SEQ ID NO: 3979 - RNA, 19 nt, Artificial Sequence
  siRNA Antisense Sequence
ucgggcaguagggacacaa

SEQ ID NO: 3980 - RNA, 19 nt, Artificial Sequence
  siRNA Sense Sequence
ugugucccuacugcccgaa

SEQ ID NO: 3981 - RNA, 19 nt, Artificial Sequence
  siRNA Antisense Sequence
uucgggcaguagggacaca

SEQ ID NO: 3982 - RNA, 19 nt, Artificial Sequence
  siRNA Sense Sequence
gugucccuacugcccgaag

SEQ ID NO: 3983 - RNA, 19 nt, Artificial Sequence
  siRNA Antisense Sequence
cuucgggcaguagggacac

SEQ ID NO: 3984 - RNA, 19 nt, Artificial Sequence
  siRNA Sense Sequence
ugucccuacugcccgaagg

SEQ ID NO: 3985 - RNA, 19 nt, Artificial Sequence
  siRNA Antisense Sequence
ccuucgggcaguagggaca

SEQ ID NO: 3986 - RNA, 19 nt, Artificial Sequence
  siRNA Sense Sequence
ucucucuccucuaccugga

SEQ ID NO: 3987 - RNA, 19 nt, Artificial Sequence
  siRNA Antisense Sequence
uccagguagaggagagaga

SEQ ID NO: 3988 - RNA, 19 nt, Artificial Sequence
  siRNA Sense Sequence
ucuccucuaccuggaucau

SEQ ID NO: 3989 - RNA, 19 nt, Artificial Sequence
  siRNA Antisense Sequence
augauccagguagaggaga

SEQ ID NO: 3990 - RNA, 19 nt, Artificial Sequence
  siRNA Sense Sequence
cuccucuaccuggaucaua

SEQ ID NO: 3991 - RNA, 19 nt, Artificial Sequence
  siRNA Antisense Sequence
uaugauccagguagaggag

SEQ ID NO: 3992 - RNA, 19 nt, Artificial Sequence
  siRNA Sense Sequence
uccucuaccuggaucauaa

SEQ ID NO: 3993 - RNA, 19 nt, Artificial Sequence
  siRNA Antisense Sequence
uuaugauccagguagagga

SEQ ID NO: 3994 - RNA, 19 nt, Artificial Sequence
  siRNA Sense Sequence
ccucuaccuggaucauaau

SEQ ID NO: 3995 - RNA, 19 nt, Artificial Sequence
  siRNA Antisense Sequence
auuaugauccagguagagg

SEQ ID NO: 3996 - RNA, 19 nt, Artificial Sequence
  siRNA Sense Sequence
cucuaccuggaucauaaug

SEQ ID NO: 3997 - RNA, 19 nt, Artificial Sequence
  siRNA Antisense Sequence
cauuaugauccagguagag

SEQ ID NO: 3998 - RNA, 19 nt, Artificial Sequence
  siRNA Sense Sequence
ucuaccuggaucauaaugg

SEQ ID NO: 3999 - RNA, 19 nt, Artificial Sequence
  siRNA Antisense Sequence
ccauuaugauccagguaga

SEQ ID NO: 4000 - RNA, 19 nt, Artificial Sequence
  siRNA Sense Sequence
cuaccuggaucauaauggc

SEQ ID NO: 4001 - RNA, 19 nt, Artificial Sequence
  siRNA Antisense Sequence
gccauuaugauccagguag

SEQ ID NO: 4002 - RNA, 19 nt, Artificial Sequence
  siRNA Sense Sequence
uaccuggaucauaauggca

SEQ ID NO: 4003 - RNA, 19 nt, Artificial Sequence
  siRNA Antisense Sequence
ugccauuaugauccaggua

SEQ ID NO: 4004 - RNA, 19 nt, Artificial Sequence
  siRNA Sense Sequence
accuggaucauaauggcaa

SEQ ID NO: 4005 - RNA, 19 nt, Artificial Sequence
  siRNA Antisense Sequence
uugccauuaugauccaggu

SEQ ID NO: 4006 - RNA, 19 nt, Artificial Sequence
  siRNA Sense Sequence
ccuggaucauaauggcaau

SEQ ID NO: 4007 - RNA, 19 nt, Artificial Sequence
  siRNA Antisense Sequence
auugccauuaugauccagg

SEQ ID NO: 4008 - RNA, 19 nt, Artificial Sequence
  siRNA Sense Sequence
cuggaucauaauggcaaug

SEQ ID NO: 4009 - RNA, 19 nt, Artificial Sequence
  siRNA Antisense Sequence
cauugccauuaugauccag

SEQ ID NO: 4010 - RNA, 19 nt, Artificial Sequence
  siRNA Sense Sequence
uggaucauaauggcaaugu

SEQ ID NO: 4011 - RNA, 19 nt, Artificial Sequence
  siRNA Antisense Sequence
acauugccauuaugaucca

SEQ ID NO: 4012 - RNA, 19 nt, Artificial Sequence
  siRNA Sense Sequence
ggaucauaauggcaaugug

SEQ ID NO: 4013 - RNA, 19 nt, Artificial Sequence
  siRNA Antisense Sequence
cacauugccauuaugaucc

SEQ ID NO: 4014 - RNA, 19 nt, Artificial Sequence
  siRNA Sense Sequence
gaucauaauggcaaugugg

SEQ ID NO: 4015 - RNA, 19 nt, Artificial Sequence
  siRNA Antisense Sequence
ccacauugccauuaugauc

SEQ ID NO: 4016 - RNA, 19 nt, Artificial Sequence
  siRNA Sense Sequence
auaauggcaauguggucaa

SEQ ID NO: 4017 - RNA, 19 nt, Artificial Sequence
  siRNA Antisense Sequence
uugaccacauugccauuau

SEQ ID NO: 4018 - RNA, 19 nt, Artificial Sequence
  siRNA Sense Sequence
uaauggcaauguggucaag

SEQ ID NO: 4019 - RNA, 19 nt, Artificial Sequence
  siRNA Antisense Sequence
cuugaccacauugccauua

SEQ ID NO: 4020 - RNA, 19 nt, Artificial Sequence
  siRNA Sense Sequence
aauggcaauguggucaaga

SEQ ID NO: 4021 - RNA, 19 nt, Artificial Sequence
  siRNA Antisense Sequence
ucuugaccacauugccauu

SEQ ID NO: 4022 - RNA, 19 nt, Artificial Sequence
  siRNA Sense Sequence
aauguggucaagacggaug

SEQ ID NO: 4023 - RNA, 19 nt, Artificial Sequence
  siRNA Antisense Sequence
cauccgucuugaccacauu

SEQ ID NO: 4024 - RNA, 19 nt, Artificial Sequence
  siRNA Sense Sequence
auguggucaagacggaugu

SEQ ID NO: 4025 - RNA, 19 nt, Artificial Sequence
  siRNA Antisense Sequence
acauccgucuugaccacau

SEQ ID NO: 4026 - RNA, 19 nt, Artificial Sequence
  siRNA Sense Sequence
uguggucaagacggaugug

SEQ ID NO: 4027 - RNA, 19 nt, Artificial Sequence
  siRNA Antisense Sequence
cacauccgucuugaccaca

SEQ ID NO: 4028 - RNA, 19 nt, Artificial Sequence
  siRNA Sense Sequence
guggucaagacggaugugc

SEQ ID NO: 4029 - RNA, 19 nt, Artificial Sequence
  siRNA Antisense Sequence
gcacauccgucuugaccac

SEQ ID NO: 4030 - RNA, 19 nt, Artificial Sequence
  siRNA Sense Sequence
uggucaagacggaugugcc

SEQ ID NO: 4031 - RNA, 19 nt, Artificial Sequence
  siRNA Antisense Sequence
ggcacauccgucuugacca

SEQ ID NO: 4032 - RNA, 19 nt, Artificial Sequence
  siRNA Sense Sequence
ggucaagacggaugugcca

SEQ ID NO: 4033 - RNA, 19 nt, Artificial Sequence
  siRNA Antisense Sequence
uggcacauccgucuugacc

SEQ ID NO: 4034 - RNA, 19 nt, Artificial Sequence
  siRNA Sense Sequence
gucaagacggaugugccag

SEQ ID NO: 4035 - RNA, 19 nt, Artificial Sequence
  siRNA Antisense Sequence
cuggcacauccgucuugac

SEQ ID NO: 4036 - RNA, 19 nt, Artificial Sequence
  siRNA Sense Sequence
ucaagacggaugugccaga

SEQ ID NO: 4037 - RNA, 19 nt, Artificial Sequence
  siRNA Antisense Sequence
ucuggcacauccgucuuga

SEQ ID NO: 4038 - RNA, 19 nt, Artificial Sequence
  siRNA Sense Sequence
caagacggaugugccagau

SEQ ID NO: 4039 - RNA, 19 nt, Artificial Sequence
  siRNA Antisense Sequence
aucuggcacauccgucuug

SEQ ID NO: 4040 - RNA, 19 nt, Artificial Sequence
  siRNA Sense Sequence
aagacggaugugccagaua

SEQ ID NO: 4041 - RNA, 19 nt, Artificial Sequence
  siRNA Antisense Sequence
uaucuggcacauccgucuu

SEQ ID NO: 4042 - RNA, 19 nt, Artificial Sequence
  siRNA Sense Sequence
agacggaugugccagauau

SEQ ID NO: 4043 - RNA, 19 nt, Artificial Sequence
  siRNA Antisense Sequence
auaucuggcacauccgucu

SEQ ID NO: 4044 - RNA, 19 nt, Artificial Sequence
  siRNA Sense Sequence
gacggaugugccagauaug

SEQ ID NO: 4045 - RNA, 19 nt, Artificial Sequence
  siRNA Antisense Sequence
cauaucuggcacauccguc

SEQ ID NO: 4046 - RNA, 19 nt, Artificial Sequence
  siRNA Sense Sequence
acggaugugccagauaugg

SEQ ID NO: 4047 - RNA, 19 nt, Artificial Sequence
  siRNA Antisense Sequence
ccauaucuggcacauccgu

SEQ ID NO: 4048 - RNA, 19 nt, Artificial Sequence
  siRNA Sense Sequence
cggaugugccagauauggu

SEQ ID NO: 4049 - RNA, 19 nt, Artificial Sequence
  siRNA Antisense Sequence
accauaucuggcacauccg

SEQ ID NO: 4050 - RNA, 19 nt, Artificial Sequence
  siRNA Sense Sequence
ggaugugccagauauggug

SEQ ID NO: 4051 - RNA, 19 nt, Artificial Sequence
  siRNA Antisense Sequence
caccauaucuggcacaucc

SEQ ID NO: 4052 - RNA, 19 nt, Artificial Sequence
  siRNA Sense Sequence
gaugugccagauauggugg

SEQ ID NO: 4053 - RNA, 19 nt, Artificial Sequence
  siRNA Antisense Sequence
ccaccauaucuggcacauc

SEQ ID NO: 4054 - RNA, 19 nt, Artificial Sequence
  siRNA Sense Sequence
gccagauauggugguggag

SEQ ID NO: 4055 - RNA, 19 nt, Artificial Sequence
  siRNA Antisense Sequence
cuccaccaccauaucuggc

SEQ ID NO: 4056 - RNA, 19 nt, Artificial Sequence
  siRNA Sense Sequence
ccagauauggugguggagg

SEQ ID NO: 4057 - RNA, 19 nt, Artificial Sequence
  siRNA Antisense Sequence
ccuccaccaccauaucugg

SEQ ID NO: 4058 - RNA, 19 nt, Artificial Sequence
  siRNA Sense Sequence
cagauauggugguggaggc

SEQ ID NO: 4059 - RNA, 19 nt, Artificial Sequence
  siRNA Antisense Sequence
gccuccaccaccauaucug

SEQ ID NO: 4060 - RNA, 19 nt, Artificial Sequence
  siRNA Sense Sequence
agauauggugguggaggcc

SEQ ID NO: 4061 - RNA, 19 nt, Artificial Sequence
  siRNA Antisense Sequence
ggccuccaccaccauaucu

SEQ ID NO: 4062 - RNA, 19 nt, Artificial Sequence
  siRNA Sense Sequence
gauauggugguggaggccu

SEQ ID NO: 4063 - RNA, 19 nt, Artificial Sequence
  siRNA Antisense Sequence
aggccuccaccaccauauc

SEQ ID NO: 4064 - RNA, 19 nt, Artificial Sequence
  siRNA Sense Sequence
auauggugguggaggccug

SEQ ID NO: 4065 - RNA, 19 nt, Artificial Sequence
  siRNA Antisense Sequence
caggccuccaccaccauau

SEQ ID NO: 4066 - RNA, 19 nt, Artificial Sequence
  siRNA Sense Sequence
ccuguggcugcagcuagca

SEQ ID NO: 4067 - RNA, 19 nt, Artificial Sequence
  siRNA Antisense Sequence
ugcuagcugcagccacagg

SEQ ID NO: 4068 - RNA, 19 nt, Artificial Sequence
  siRNA Sense Sequence
uguggcugcagcuagcaag

SEQ ID NO: 4069 - RNA, 19 nt, Artificial Sequence
  siRNA Antisense Sequence
cuugcuagcugcagccaca

SEQ ID NO: 4070 - RNA, 19 nt, Artificial Sequence
  siRNA Sense Sequence
guggcugcagcuagcaaga

SEQ ID NO: 4071 - RNA, 19 nt, Artificial Sequence
  siRNA Antisense Sequence
ucuugcuagcugcagccac

SEQ ID NO: 4072 - RNA, 19 nt, Artificial Sequence
  siRNA Sense Sequence
uggcugcagcuagcaagag

SEQ ID NO: 4073 - RNA, 19 nt, Artificial Sequence
  siRNA Antisense Sequence
cucuugcuagcugcagcca

SEQ ID NO: 4074 - RNA, 19 nt, Artificial Sequence
  siRNA Sense Sequence
ggcugcagcuagcaagagg

SEQ ID NO: 4075 - RNA, 19 nt, Artificial Sequence
  siRNA Antisense Sequence
ccucuugcuagcugcagcc

SEQ ID NO: 4076 - RNA, 19 nt, Artificial Sequence
  siRNA Sense Sequence
cugcagcuagcaagaggac

SEQ ID NO: 4077 - RNA, 19 nt, Artificial Sequence
  siRNA Antisense Sequence
guccucuugcuagcugcag

SEQ ID NO: 4078 - RNA, 19 nt, Artificial Sequence
  siRNA Sense Sequence
cagcuagcaagaggaccug

SEQ ID NO: 4079 - RNA, 19 nt, Artificial Sequence
  siRNA Antisense Sequence
cagguccucuugcuagcug

SEQ ID NO: 4080 - RNA, 19 nt, Artificial Sequence
  siRNA Sense Sequence
gcuagcaagaggaccuggg

SEQ ID NO: 4081 - RNA, 19 nt, Artificial Sequence
  siRNA Antisense Sequence
cccagguccucuugcuagc

SEQ ID NO: 4082 - RNA, 19 nt, Artificial Sequence
  siRNA Sense Sequence
agaccaagaugaaguuucc

SEQ ID NO: 4083 - RNA, 19 nt, Artificial Sequence
  siRNA Antisense Sequence
ggaaacuucaucuuggucu

SEQ ID NO: 4084 - RNA, 19 nt, Artificial Sequence
  siRNA Sense Sequence
ugaaguuucccaggcacag

SEQ ID NO: 4085 - RNA, 19 nt, Artificial Sequence
  siRNA Antisense Sequence
cugugccugggaaacuuca

SEQ ID NO: 4086 - RNA, 19 nt, Artificial Sequence
  siRNA Sense Sequence
gaaguuucccaggcacagg

SEQ ID NO: 4087 - RNA, 19 nt, Artificial Sequence
  siRNA Antisense Sequence
ccugugccugggaaacuuc

SEQ ID NO: 4088 - RNA, 19 nt, Artificial Sequence
  siRNA Sense Sequence
ucccaggcacagggcaucu

SEQ ID NO: 4089 - RNA, 19 nt, Artificial Sequence
  siRNA Antisense Sequence
agaugcccugugccuggga

SEQ ID NO: 4090 - RNA, 19 nt, Artificial Sequence
  siRNA Sense Sequence
ggcaucugugacuggaggc

SEQ ID NO: 4091 - RNA, 19 nt, Artificial Sequence
  siRNA Antisense Sequence
gccuccagucacagaugcc

SEQ ID NO: 4092 - RNA, 19 nt, Artificial Sequence
  siRNA Sense Sequence
gcaucugugacuggaggca

SEQ ID NO: 4093 - RNA, 19 nt, Artificial Sequence
  siRNA Antisense Sequence
ugccuccagucacagaugc

SEQ ID NO: 4094 - RNA, 19 nt, Artificial Sequence
  siRNA Sense Sequence
caaccaccuggcaauauga

SEQ ID NO: 4095 - RNA, 19 nt, Artificial Sequence
  siRNA Antisense Sequence
ucauauugccaggugguug

SEQ ID NO: 4096 - RNA, 19 nt, Artificial Sequence
  siRNA Sense Sequence
aaccaccuggcaauaugac

SEQ ID NO: 4097 - RNA, 19 nt, Artificial Sequence
  siRNA Antisense Sequence
gucauauugccaggugguu

SEQ ID NO: 4098 - RNA, 19 nt, Artificial Sequence
  siRNA Sense Sequence
accaccuggcaauaugacu

SEQ ID NO: 4099 - RNA, 19 nt, Artificial Sequence
  siRNA Antisense Sequence
agucauauugccagguggu

SEQ ID NO: 4100 - RNA, 19 nt, Artificial Sequence
  siRNA Sense Sequence
ccaccuggcaauaugacuc

SEQ ID NO: 4101 - RNA, 19 nt, Artificial Sequence
  siRNA Antisense Sequence
gagucauauugccaggugg

SEQ ID NO: 4102 - RNA, 19 nt, Artificial Sequence
  siRNA Sense Sequence
caccuggcaauaugacuca

SEQ ID NO: 4103 - RNA, 19 nt, Artificial Sequence
  siRNA Antisense Sequence
ugagucauauugccaggug

SEQ ID NO: 4104 - RNA, 19 nt, Artificial Sequence
  siRNA Sense Sequence
accuggcaauaugacucac

SEQ ID NO: 4105 - RNA, 19 nt, Artificial Sequence
  siRNA Antisense Sequence
gugagucauauugccaggu

SEQ ID NO: 4106 - RNA, 19 nt, Artificial Sequence
  siRNA Sense Sequence
ccuggcaauaugacucacu

SEQ ID NO: 4107 - RNA, 19 nt, Artificial Sequence
  siRNA Antisense Sequence
agugagucauauugccagg

SEQ ID NO: 4108 - RNA, 19 nt, Artificial Sequence
  siRNA Sense Sequence
cuggcaauaugacucacuu

SEQ ID NO: 4109 - RNA, 19 nt, Artificial Sequence
  siRNA Antisense Sequence
aagugagucauauugccag

SEQ ID NO: 4110 - RNA, 19 nt, Artificial Sequence
  siRNA Sense Sequence
uggcaauaugacucacuug

SEQ ID NO: 4111 - RNA, 19 nt, Artificial Sequence
  siRNA Antisense Sequence
caagugagucauauugcca

SEQ ID NO: 4112 - RNA, 19 nt, Artificial Sequence
  siRNA Sense Sequence
aauaugacucacuugaccc

SEQ ID NO: 4113 - RNA, 19 nt, Artificial Sequence
  siRNA Antisense Sequence
gggucaagugagucauauu

SEQ ID NO: 4114 - RNA, 19 nt, Artificial Sequence
  siRNA Sense Sequence
cccuaugggacccaaaugg

SEQ ID NO: 4115 - RNA, 19 nt, Artificial Sequence
  siRNA Antisense Sequence
ccauuugggucccauaggg

SEQ ID NO: 4116 - RNA, 19 nt, Artificial Sequence
  siRNA Sense Sequence
ccuaugggacccaaauggg

SEQ ID NO: 4117 - RNA, 19 nt, Artificial Sequence
  siRNA Antisense Sequence
cccauuugggucccauagg

SEQ ID NO: 4118 - RNA, 19 nt, Artificial Sequence
  siRNA Sense Sequence
cuaugggacccaaaugggc

SEQ ID NO: 4119 - RNA, 19 nt, Artificial Sequence
  siRNA Antisense Sequence
gcccauuugggucccauag

SEQ ID NO: 4120 - RNA, 19 nt, Artificial Sequence
  siRNA Sense Sequence
uaugggacccaaaugggca

SEQ ID NO: 4121 - RNA, 19 nt, Artificial Sequence
  siRNA Antisense Sequence
ugcccauuugggucccaua

SEQ ID NO: 4122 - RNA, 19 nt, Artificial Sequence
  siRNA Sense Sequence
augggacccaaaugggcac

SEQ ID NO: 4123 - RNA, 19 nt, Artificial Sequence
  siRNA Antisense Sequence
gugcccauuugggucccau

SEQ ID NO: 4124 - RNA, 19 nt, Artificial Sequence
  siRNA Sense Sequence
cccaaaugggcacuuucuu

SEQ ID NO: 4125 - RNA, 19 nt, Artificial Sequence
  siRNA Antisense Sequence
aagaaagugcccauuuggg

SEQ ID NO: 4126 - RNA, 19 nt, Artificial Sequence
  siRNA Sense Sequence
ccaaaugggcacuuucuug

SEQ ID NO: 4127 - RNA, 19 nt, Artificial Sequence
  siRNA Antisense Sequence
caagaaagugcccauuugg

SEQ ID NO: 4128 - RNA, 19 nt, Artificial Sequence
  siRNA Sense Sequence
caaaugggcacuuucuugu

SEQ ID NO: 4129 - RNA, 19 nt, Artificial Sequence
  siRNA Antisense Sequence
acaagaaagugcccauuug

SEQ ID NO: 4130 - RNA, 19 nt, Artificial Sequence
  siRNA Sense Sequence
aaaugggcacuuucuuguc

SEQ ID NO: 4131 - RNA, 19 nt, Artificial Sequence
  siRNA Antisense Sequence
gacaagaaagugcccauuu

SEQ ID NO: 4132 - RNA, 19 nt, Artificial Sequence
  siRNA Sense Sequence
aaugggcacuuucuugucu

SEQ ID NO: 4133 - RNA, 19 nt, Artificial Sequence
  siRNA Antisense Sequence
agacaagaaagugcccauu

SEQ ID NO: 4134 - RNA, 19 nt, Artificial Sequence
  siRNA Sense Sequence
ugggcacuuucuugucuga

SEQ ID NO: 4135 - RNA, 19 nt, Artificial Sequence
  siRNA Antisense Sequence
ucagacaagaaagugccca

SEQ ID NO: 4136 - RNA, 19 nt, Artificial Sequence
  siRNA Sense Sequence
gggcacuuucuugucugag

SEQ ID NO: 4137 - RNA, 19 nt, Artificial Sequence
  siRNA Antisense Sequence
cucagacaagaaagugccc

SEQ ID NO: 4138 - RNA, 19 nt, Artificial Sequence
  siRNA Sense Sequence
uggcuuauuccagguuggc

SEQ ID NO: 4139 - RNA, 19 nt, Artificial Sequence
  siRNA Antisense Sequence
gccaaccuggaauaagcca

SEQ ID NO: 4140 - RNA, 19 nt, Artificial Sequence
  siRNA Sense Sequence
ggcuuauuccagguuggcu

SEQ ID NO: 4141 - RNA, 19 nt, Artificial Sequence
  siRNA Antisense Sequence
agccaaccuggaauaagcc

SEQ ID NO: 4142 - RNA, 19 nt, Artificial Sequence
  siRNA Sense Sequence
gcuuauuccagguuggcug

SEQ ID NO: 4143 - RNA, 19 nt, Artificial Sequence
  siRNA Antisense Sequence
cagccaaccuggaauaagc

SEQ ID NO: 4144 - RNA, 19 nt, Artificial Sequence
  siRNA Sense Sequence
cuuauuccagguuggcuga

SEQ ID NO: 4145 - RNA, 19 nt, Artificial Sequence
  siRNA Antisense Sequence
ucagccaaccuggaauaag

SEQ ID NO: 4146 - RNA, 19 nt, Artificial Sequence
  siRNA Sense Sequence
uuccagguuggcugaugug

SEQ ID NO: 4147 - RNA, 19 nt, Artificial Sequence
  siRNA Antisense Sequence
cacaucagccaaccuggaa

SEQ ID NO: 4148 - RNA, 19 nt, Artificial Sequence
  siRNA Sense Sequence
uccagguuggcugaugugu

SEQ ID NO: 4149 - RNA, 19 nt, Artificial Sequence
  siRNA Antisense Sequence
acacaucagccaaccugga

SEQ ID NO: 4150 - RNA, 19 nt, Artificial Sequence
  siRNA Sense Sequence
ccagguuggcugauguguu

SEQ ID NO: 4151 - RNA, 19 nt, Artificial Sequence
  siRNA Antisense Sequence
aacacaucagccaaccugg

SEQ ID NO: 4152 - RNA, 19 nt, Artificial Sequence
  siRNA Sense Sequence
cagguuggcugauguguug

SEQ ID NO: 4153 - RNA, 19 nt, Artificial Sequence
  siRNA Antisense Sequence
caacacaucagccaaccug

SEQ ID NO: 4154 - RNA, 19 nt, Artificial Sequence
  siRNA Sense Sequence
agguuggcugauguguugg

SEQ ID NO: 4155 - RNA, 19 nt, Artificial Sequence
  siRNA Antisense Sequence
ccaacacaucagccaaccu

SEQ ID NO: 4156 - RNA, 19 nt, Artificial Sequence
  siRNA Sense Sequence
gguuggcugauguguuggg

SEQ ID NO: 4157 - RNA, 19 nt, Artificial Sequence
  siRNA Antisense Sequence
cccaacacaucagccaacc

SEQ ID NO: 4158 - RNA, 19 nt, Artificial Sequence
  siRNA Sense Sequence
agauggguaaagcguuucu

SEQ ID NO: 4159 - RNA, 19 nt, Artificial Sequence
  siRNA Antisense Sequence
agaaacgcuuuacccaucu

SEQ ID NO: 4160 - RNA, 19 nt, Artificial Sequence
  siRNA Sense Sequence
gauggguaaagcguuucuu

SEQ ID NO: 4161 - RNA, 19 nt, Artificial Sequence
  siRNA Antisense Sequence
aagaaacgcuuuacccauc

SEQ ID NO: 4162 - RNA, 19 nt, Artificial Sequence
  siRNA Sense Sequence
auggguaaagcguuucuuc

SEQ ID NO: 4163 - RNA, 19 nt, Artificial Sequence
  siRNA Antisense Sequence
gaagaaacgcuuuacccau

SEQ ID NO: 4164 - RNA, 19 nt, Artificial Sequence
  siRNA Sense Sequence
uggguaaagcguuucuucu

SEQ ID NO: 4165 - RNA, 19 nt, Artificial Sequence
  siRNA Antisense Sequence
agaagaaacgcuuuaccca

SEQ ID NO: 4166 - RNA, 19 nt, Artificial Sequence
  siRNA Sense Sequence
ggguaaagcguuucuucua

SEQ ID NO: 4167 - RNA, 19 nt, Artificial Sequence
  siRNA Antisense Sequence
uagaagaaacgcuuuaccc

SEQ ID NO: 4168 - RNA, 19 nt, Artificial Sequence
  siRNA Sense Sequence
gguaaagcguuucuucuaa

SEQ ID NO: 4169 - RNA, 19 nt, Artificial Sequence
  siRNA Antisense Sequence
uuagaagaaacgcuuuacc

SEQ ID NO: 4170 - RNA, 19 nt, Artificial Sequence
  siRNA Sense Sequence
guaaagcguuucuucuaaa

SEQ ID NO: 4171 - RNA, 19 nt, Artificial Sequence
  siRNA Antisense Sequence
uuuagaagaaacgcuuuac

SEQ ID NO: 4172 - RNA, 19 nt, Artificial Sequence
  siRNA Sense Sequence
uaaagcguuucuucuaaag

SEQ ID NO: 4173 - RNA, 19 nt, Artificial Sequence
  siRNA Antisense Sequence
cuuuagaagaaacgcuuua

SEQ ID NO: 4174 - RNA, 19 nt, Artificial Sequence
  siRNA Sense Sequence
aaagcguuucuucuaaagg

SEQ ID NO: 4175 - RNA, 19 nt, Artificial Sequence
  siRNA Antisense Sequence
ccuuuagaagaaacgcuuu

SEQ ID NO: 4176 - RNA, 19 nt, Artificial Sequence
  siRNA Sense Sequence
aagcguuucuucuaaaggg

SEQ ID NO: 4177 - RNA, 19 nt, Artificial Sequence
  siRNA Antisense Sequence
cccuuuagaagaaacgcuu

SEQ ID NO: 4178 - RNA, 19 nt, Artificial Sequence
  siRNA Sense Sequence
aaagcaugauuuccugccc

SEQ ID NO: 4179 - RNA, 19 nt, Artificial Sequence
  siRNA Antisense Sequence
gggcaggaaaucaugcuuu

SEQ ID NO: 4180 - RNA, 19 nt, Artificial Sequence
  siRNA Sense Sequence
aagcaugauuuccugcccu

SEQ ID NO: 4181 - RNA, 19 nt, Artificial Sequence
  siRNA Antisense Sequence
agggcaggaaaucaugcuu

SEQ ID NO: 4182 - RNA, 19 nt, Artificial Sequence
  siRNA Sense Sequence
agcaugauuuccugcccua

SEQ ID NO: 4183 - RNA, 19 nt, Artificial Sequence
  siRNA Antisense Sequence
uagggcaggaaaucaugcu

SEQ ID NO: 4184 - RNA, 19 nt, Artificial Sequence
  siRNA Sense Sequence
gcaugauuuccugcccuaa

SEQ ID NO: 4185 - RNA, 19 nt, Artificial Sequence
  siRNA Antisense Sequence
uuagggcaggaaaucaugc

SEQ ID NO: 4186 - RNA, 19 nt, Artificial Sequence
  siRNA Sense Sequence
caugauuuccugcccuaag

SEQ ID NO: 4187 - RNA, 19 nt, Artificial Sequence
  siRNA Antisense Sequence
cuuagggcaggaaaucaug

SEQ ID NO: 4188 - RNA, 19 nt, Artificial Sequence
  siRNA Sense Sequence
augauuuccugcccuaagu

SEQ ID NO: 4189 - RNA, 19 nt, Artificial Sequence
  siRNA Antisense Sequence
acuuagggcaggaaaucau

SEQ ID NO: 4190 - RNA, 19 nt, Artificial Sequence
  siRNA Sense Sequence
ugauuuccugcccuaaguc

SEQ ID NO: 4191 - RNA, 19 nt, Artificial Sequence
  siRNA Antisense Sequence
gacuuagggcaggaaauca

SEQ ID NO: 4192 - RNA, 19 nt, Artificial Sequence
  siRNA Sense Sequence
gauuuccugcccuaagucc

SEQ ID NO: 4193 - RNA, 19 nt, Artificial Sequence
  siRNA Antisense Sequence
ggacuuagggcaggaaauc

SEQ ID NO: 4194 - RNA, 19 nt, Artificial Sequence
  siRNA Sense Sequence
auuuccugcccuaaguccu

SEQ ID NO: 4195 - RNA, 19 nt, Artificial Sequence
  siRNA Antisense Sequence
aggacuuagggcaggaaau

SEQ ID NO: 4196 - RNA, 19 nt, Artificial Sequence
  siRNA Sense Sequence
uuuccugcccuaaguccug

SEQ ID NO: 4197 - RNA, 19 nt, Artificial Sequence
  siRNA Antisense Sequence
caggacuuagggcaggaaa

SEQ ID NO: 4198 - RNA, 19 nt, Artificial Sequence
  siRNA Sense Sequence
uuccugcccuaaguccugu

SEQ ID NO: 4199 - RNA, 19 nt, Artificial Sequence
  siRNA Antisense Sequence
acaggacuuagggcaggaa

SEQ ID NO: 4200 - RNA, 19 nt, Artificial Sequence
  siRNA Sense Sequence
uccugcccuaaguccugug

SEQ ID NO: 4201 - RNA, 19 nt, Artificial Sequence
  siRNA Antisense Sequence
cacaggacuuagggcagga

SEQ ID NO: 4202 - RNA, 19 nt, Artificial Sequence
  siRNA Sense Sequence
agaagaugucagggacuag

SEQ ID NO: 4203 - RNA, 19 nt, Artificial Sequence
  siRNA Antisense Sequence
cuagucccugacaucuucu

SEQ ID NO: 4204 - RNA, 19 nt, Artificial Sequence
  siRNA Sense Sequence
gaagaugucagggacuagg

SEQ ID NO: 4205 - RNA, 19 nt, Artificial Sequence
  siRNA Antisense Sequence
ccuagucccugacaucuuc

SEQ ID NO: 4206 - RNA, 19 nt, Artificial Sequence
  siRNA Sense Sequence
aagaugucagggacuaggg

SEQ ID NO: 4207 - RNA, 19 nt, Artificial Sequence
  siRNA Antisense Sequence
cccuagucccugacaucuu

SEQ ID NO: 4208 - RNA, 19 nt, Artificial Sequence
  siRNA Sense Sequence
agaugucagggacuaggga

SEQ ID NO: 4209 - RNA, 19 nt, Artificial Sequence
  siRNA Antisense Sequence
ucccuagucccugacaucu

SEQ ID NO: 4210 - RNA, 19 nt, Artificial Sequence
  siRNA Sense Sequence
gucagggacuagggaggga

SEQ ID NO: 4211 - RNA, 19 nt, Artificial Sequence
  siRNA Antisense Sequence
ucccucccuagucccugac

SEQ ID NO: 4212 - RNA, 19 nt, Artificial Sequence
  siRNA Sense Sequence
uacuuagccucucccaaga

SEQ ID NO: 4213 - RNA, 19 nt, Artificial Sequence
  siRNA Antisense Sequence
ucuugggagaggcuaagua

SEQ ID NO: 4214 - RNA, 19 nt, Artificial Sequence
  siRNA Sense Sequence
aggaggaagcagauagaug

SEQ ID NO: 4215 - RNA, 19 nt, Artificial Sequence
  siRNA Antisense Sequence
caucuaucugcuuccuccu

SEQ ID NO: 4216 - RNA, 19 nt, Artificial Sequence
  siRNA Sense Sequence
ggaggaagcagauagaugg

SEQ ID NO: 4217 - RNA, 19 nt, Artificial Sequence
  siRNA Antisense Sequence
ccaucuaucugcuuccucc

SEQ ID NO: 4218 - RNA, 19 nt, Artificial Sequence
  siRNA Sense Sequence
gaggaagcagauagauggu

SEQ ID NO: 4219 - RNA, 19 nt, Artificial Sequence
  siRNA Antisense Sequence
accaucuaucugcuuccuc

SEQ ID NO: 4220 - RNA, 19 nt, Artificial Sequence
  siRNA Sense Sequence
aggaagcagauagaugguc

SEQ ID NO: 4221 - RNA, 19 nt, Artificial Sequence
  siRNA Antisense Sequence
gaccaucuaucugcuuccu

SEQ ID NO: 4222 - RNA, 19 nt, Artificial Sequence
  siRNA Sense Sequence
ggaagcagauagauggucc

SEQ ID NO: 4223 - RNA, 19 nt, Artificial Sequence
  siRNA Antisense Sequence
ggaccaucuaucugcuucc

SEQ ID NO: 4224 - RNA, 19 nt, Artificial Sequence
  siRNA Sense Sequence
gaagcagauagauggucca

SEQ ID NO: 4225 - RNA, 19 nt, Artificial Sequence
  siRNA Antisense Sequence
uggaccaucuaucugcuuc

SEQ ID NO: 4226 - RNA, 19 nt, Artificial Sequence
  siRNA Sense Sequence
uagaugguccagcaggcuu

SEQ ID NO: 4227 - RNA, 19 nt, Artificial Sequence
  siRNA Antisense Sequence
aagccugcuggaccaucua

SEQ ID NO: 4228 - RNA, 19 nt, Artificial Sequence
  siRNA Sense Sequence
agaugguccagcaggcuug

SEQ ID NO: 4229 - RNA, 19 nt, Artificial Sequence
  siRNA Antisense Sequence
caagccugcuggaccaucu

SEQ ID NO: 4230 - RNA, 19 nt, Artificial Sequence
  siRNA Sense Sequence
gaugguccagcaggcuuga

SEQ ID NO: 4231 - RNA, 19 nt, Artificial Sequence
  siRNA Antisense Sequence
ucaagccugcuggaccauc

SEQ ID NO: 4232 - RNA, 19 nt, Artificial Sequence
  siRNA Sense Sequence
augguccagcaggcuugaa

SEQ ID NO: 4233 - RNA, 19 nt, Artificial Sequence
  siRNA Antisense Sequence
uucaagccugcuggaccau

SEQ ID NO: 4234 - RNA, 19 nt, Artificial Sequence
  siRNA Sense Sequence
ugguccagcaggcuugaag

SEQ ID NO: 4235 - RNA, 19 nt, Artificial Sequence
  siRNA Antisense Sequence
cuucaagccugcuggacca

SEQ ID NO: 4236 - RNA, 19 nt, Artificial Sequence
  siRNA Sense Sequence
gguccagcaggcuugaagc

SEQ ID NO: 4237 - RNA, 19 nt, Artificial Sequence
  siRNA Antisense Sequence
gcuucaagccugcuggacc

SEQ ID NO: 4238 - RNA, 19 nt, Artificial Sequence
  siRNA Sense Sequence
guccagcaggcuugaagca

SEQ ID NO: 4239 - RNA, 19 nt, Artificial Sequence
  siRNA Antisense Sequence
ugcuucaagccugcuggac

SEQ ID NO: 4240 - RNA, 19 nt, Artificial Sequence
  siRNA Sense Sequence
uccagcaggcuugaagcag

SEQ ID NO: 4241 - RNA, 19 nt, Artificial Sequence
  siRNA Antisense Sequence
cugcuucaagccugcugga

SEQ ID NO: 4242 - RNA, 19 nt, Artificial Sequence
  siRNA Sense Sequence
cccaggguaagggcuguug

SEQ ID NO: 4243 - RNA, 19 nt, Artificial Sequence
  siRNA Antisense Sequence
caacagcccuuacccuggg

SEQ ID NO: 4244 - RNA, 19 nt, Artificial Sequence
  siRNA Sense Sequence
ggguaagggcuguugaggu

SEQ ID NO: 4245 - RNA, 19 nt, Artificial Sequence
  siRNA Antisense Sequence
accucaacagcccuuaccc

SEQ ID NO: 4246 - RNA, 19 nt, Artificial Sequence
  siRNA Sense Sequence
gguaagggcuguugaggua

SEQ ID NO: 4247 - RNA, 19 nt, Artificial Sequence
  siRNA Antisense Sequence
uaccucaacagcccuuacc

SEQ ID NO: 4248 - RNA, 19 nt, Artificial Sequence
  siRNA Sense Sequence
guaagggcuguugagguac

SEQ ID NO: 4249 - RNA, 19 nt, Artificial Sequence
  siRNA Antisense Sequence
guaccucaacagcccuuac

SEQ ID NO: 4250 - RNA, 19 nt, Artificial Sequence
  siRNA Sense Sequence
uaagggcuguugagguacc

SEQ ID NO: 4251 - RNA, 19 nt, Artificial Sequence
  siRNA Antisense Sequence
gguaccucaacagcccuua

SEQ ID NO: 4252 - RNA, 19 nt, Artificial Sequence
  siRNA Sense Sequence
aagggcuguugagguaccu

SEQ ID NO: 4253 - RNA, 19 nt, Artificial Sequence
  siRNA Antisense Sequence
agguaccucaacagcccuu

SEQ ID NO: 4254 - RNA, 19 nt, Artificial Sequence
  siRNA Sense Sequence
agggcuguugagguaccuu

SEQ ID NO: 4255 - RNA, 19 nt, Artificial Sequence
  siRNA Antisense Sequence
aagguaccucaacagcccu

SEQ ID NO: 4256 - RNA, 19 nt, Artificial Sequence
  siRNA Sense Sequence
gggcuguugagguaccuua

SEQ ID NO: 4257 - RNA, 19 nt, Artificial Sequence
  siRNA Antisense Sequence
uaagguaccucaacagccc

SEQ ID NO: 4258 - RNA, 19 nt, Artificial Sequence
  siRNA Sense Sequence
ggcuguugagguaccuuaa

SEQ ID NO: 4259 - RNA, 19 nt, Artificial Sequence
  siRNA Antisense Sequence
uuaagguaccucaacagcc

SEQ ID NO: 4260 - RNA, 19 nt, Artificial Sequence
  siRNA Sense Sequence
gcuguugagguaccuuaag

SEQ ID NO: 4261 - RNA, 19 nt, Artificial Sequence
  siRNA Antisense Sequence
cuuaagguaccucaacagc

SEQ ID NO: 4262 - RNA, 19 nt, Artificial Sequence
  siRNA Sense Sequence
cuguugagguaccuuaagg

SEQ ID NO: 4263 - RNA, 19 nt, Artificial Sequence
  siRNA Antisense Sequence
ccuuaagguaccucaacag

SEQ ID NO: 4264 - RNA, 19 nt, Artificial Sequence
  siRNA Sense Sequence
uguugagguaccuuaaggg

SEQ ID NO: 4265 - RNA, 19 nt, Artificial Sequence
  siRNA Antisense Sequence
cccuuaagguaccucaaca

SEQ ID NO: 4266 - RNA, 19 nt, Artificial Sequence
  siRNA Sense Sequence
uaagggaaggucaagaggg

SEQ ID NO: 4267 - RNA, 19 nt, Artificial Sequence
  siRNA Antisense Sequence
cccucuugaccuucccuua

SEQ ID NO: 4268 - RNA, 19 nt, Artificial Sequence
  siRNA Sense Sequence
aagggaaggucaagaggga

SEQ ID NO: 4269 - RNA, 19 nt, Artificial Sequence
  siRNA Antisense Sequence
ucccucuugaccuucccuu

SEQ ID NO: 4270 - RNA, 19 nt, Artificial Sequence
  siRNA Sense Sequence
cgcugagggaggaugcuua

SEQ ID NO: 4271 - RNA, 19 nt, Artificial Sequence
  siRNA Antisense Sequence
uaagcauccucccucagcg

SEQ ID NO: 4272 - RNA, 19 nt, Artificial Sequence
  siRNA Sense Sequence
ugagggaggaugcuuaggg

SEQ ID NO: 4273 - RNA, 19 nt, Artificial Sequence
  siRNA Antisense Sequence
cccuaagcauccucccuca

SEQ ID NO: 4274 - RNA, 19 nt, Artificial Sequence
  siRNA Sense Sequence
ggcacuaagccuaagaagu

SEQ ID NO: 4275 - RNA, 19 nt, Artificial Sequence
  siRNA Antisense Sequence
acuucuuaggcuuagugcc

SEQ ID NO: 4276 - RNA, 19 nt, Artificial Sequence
  siRNA Sense Sequence
gcacuaagccuaagaaguu

SEQ ID NO: 4277 - RNA, 19 nt, Artificial Sequence
  siRNA Antisense Sequence
aacuucuuaggcuuagugc

SEQ ID NO: 4278 - RNA, 19 nt, Artificial Sequence
  siRNA Sense Sequence
cacuaagccuaagaaguuc

SEQ ID NO: 4279 - RNA, 19 nt, Artificial Sequence
  siRNA Antisense Sequence
gaacuucuuaggcuuagug

SEQ ID NO: 4280 - RNA, 19 nt, Artificial Sequence
  siRNA Sense Sequence
acuaagccuaagaaguucc

SEQ ID NO: 4281 - RNA, 19 nt, Artificial Sequence
  siRNA Antisense Sequence
ggaacuucuuaggcuuagu

SEQ ID NO: 4282 - RNA, 19 nt, Artificial Sequence
  siRNA Sense Sequence
agaucgagucucgcucugu

SEQ ID NO: 4283 - RNA, 19 nt, Artificial Sequence
  siRNA Antisense Sequence
acagagcgagacucgaucu

SEQ ID NO: 4284 - RNA, 19 nt, Artificial Sequence
  siRNA Sense Sequence
gaucgagucucgcucuguc

SEQ ID NO: 4285 - RNA, 19 nt, Artificial Sequence
  siRNA Antisense Sequence
gacagagcgagacucgauc

SEQ ID NO: 4286 - RNA, 19 nt, Artificial Sequence
  siRNA Sense Sequence
aucgagucucgcucuguca

SEQ ID NO: 4287 - RNA, 19 nt, Artificial Sequence
  siRNA Antisense Sequence
ugacagagcgagacucgau

SEQ ID NO: 4288 - RNA, 19 nt, Artificial Sequence
  siRNA Sense Sequence
agucucgcucugucaccag

SEQ ID NO: 4289 - RNA, 19 nt, Artificial Sequence
  siRNA Antisense Sequence
cuggugacagagcgagacu

SEQ ID NO: 4290 - RNA, 19 nt, Artificial Sequence
  siRNA Sense Sequence
gucucgcucugucaccagg

SEQ ID NO: 4291 - RNA, 19 nt, Artificial Sequence
  siRNA Antisense Sequence
ccuggugacagagcgagac

SEQ ID NO: 4292 - RNA, 19 nt, Artificial Sequence
  siRNA Sense Sequence
ucucgcucugucaccaggc

SEQ ID NO: 4293 - RNA, 19 nt, Artificial Sequence
  siRNA Antisense Sequence
gccuggugacagagcgaga

SEQ ID NO: 4294 - RNA, 19 nt, Artificial Sequence
  siRNA Sense Sequence
cucgcucugucaccaggcu

SEQ ID NO: 4295 - RNA, 19 nt, Artificial Sequence
  siRNA Antisense Sequence
agccuggugacagagcgag

SEQ ID NO: 4296 - RNA, 19 nt, Artificial Sequence
  siRNA Sense Sequence
gucaccaggcuggagugca

SEQ ID NO: 4297 - RNA, 19 nt, Artificial Sequence
  siRNA Antisense Sequence
ugcacuccagccuggugac

SEQ ID NO: 4298 - RNA, 19 nt, Artificial Sequence
  siRNA Sense Sequence
ggcucacugcaaccuccgu

SEQ ID NO: 4299 - RNA, 19 nt, Artificial Sequence
  siRNA Antisense Sequence
acggagguugcagugagcc

SEQ ID NO: 4300 - RNA, 19 nt, Artificial Sequence
  siRNA Sense Sequence
gcucacugcaaccuccguc

SEQ ID NO: 4301 - RNA, 19 nt, Artificial Sequence
  siRNA Antisense Sequence
gacggagguugcagugagc

SEQ ID NO: 4302 - RNA, 19 nt, Artificial Sequence
  siRNA Sense Sequence
uccgucuccuggguucaag

SEQ ID NO: 4303 - RNA, 19 nt, Artificial Sequence
  siRNA Antisense Sequence
cuugaacccaggagacgga

SEQ ID NO: 4304 - RNA, 19 nt, Artificial Sequence
  siRNA Sense Sequence
ccgucuccuggguucaagu

SEQ ID NO: 4305 - RNA, 19 nt, Artificial Sequence
  siRNA Antisense Sequence
acuugaacccaggagacgg

SEQ ID NO: 4306 - RNA, 19 nt, Artificial Sequence
  siRNA Sense Sequence
cgucuccuggguucaagug

SEQ ID NO: 4307 - RNA, 19 nt, Artificial Sequence
  siRNA Antisense Sequence
cacuugaacccaggagacg

SEQ ID NO: 4308 - RNA, 19 nt, Artificial Sequence
  siRNA Sense Sequence
gucuccuggguucaaguga

SEQ ID NO: 4309 - RNA, 19 nt, Artificial Sequence
  siRNA Antisense Sequence
ucacuugaacccaggagac

SEQ ID NO: 4310 - RNA, 19 nt, Artificial Sequence
  siRNA Sense Sequence
uggguucaagugauucuuc

SEQ ID NO: 4311 - RNA, 19 nt, Artificial Sequence
  siRNA Antisense Sequence
gaagaaucacuugaaccca

SEQ ID NO: 4312 - RNA, 19 nt, Artificial Sequence
  siRNA Sense Sequence
ggguucaagugauucuucu

SEQ ID NO: 4313 - RNA, 19 nt, Artificial Sequence
  siRNA Antisense Sequence
agaagaaucacuugaaccc

SEQ ID NO: 4314 - RNA, 19 nt, Artificial Sequence
  siRNA Sense Sequence
gguucaagugauucuucug

SEQ ID NO: 4315 - RNA, 19 nt, Artificial Sequence
  siRNA Antisense Sequence
cagaagaaucacuugaacc

SEQ ID NO: 4316 - RNA, 19 nt, Artificial Sequence
  siRNA Sense Sequence
guucaagugauucuucugc

SEQ ID NO: 4317 - RNA, 19 nt, Artificial Sequence
  siRNA Antisense Sequence
gcagaagaaucacuugaac

SEQ ID NO: 4318 - RNA, 19 nt, Artificial Sequence
  siRNA Sense Sequence
uucaagugauucuucugcc

SEQ ID NO: 4319 - RNA, 19 nt, Artificial Sequence
  siRNA Antisense Sequence
ggcagaagaaucacuugaa

SEQ ID NO: 4320 - RNA, 19 nt, Artificial Sequence
  siRNA Sense Sequence
ucaagugauucuucugccu

SEQ ID NO: 4321 - RNA, 19 nt, Artificial Sequence
  siRNA Antisense Sequence
aggcagaagaaucacuuga

SEQ ID NO: 4322 - RNA, 19 nt, Artificial Sequence
  siRNA Sense Sequence
cgagcagcugggauuacag

SEQ ID NO: 4323 - RNA, 19 nt, Artificial Sequence
  siRNA Antisense Sequence
cuguaaucccagcugcucg

SEQ ID NO: 4324 - RNA, 19 nt, Artificial Sequence
  siRNA Sense Sequence
cagcugggauuacaggcgc

SEQ ID NO: 4325 - RNA, 19 nt, Artificial Sequence
  siRNA Antisense Sequence
gcgccuguaaucccagcug

SEQ ID NO: 4326 - RNA, 19 nt, Artificial Sequence
  siRNA Sense Sequence
acauguuggccaggauggu

SEQ ID NO: 4327 - RNA, 19 nt, Artificial Sequence
  siRNA Antisense Sequence
accauccuggccaacaugu

SEQ ID NO: 4328 - RNA, 19 nt, Artificial Sequence
  siRNA Sense Sequence
cauguuggccaggaugguc

SEQ ID NO: 4329 - RNA, 19 nt, Artificial Sequence
  siRNA Antisense Sequence
gaccauccuggccaacaug

SEQ ID NO: 4330 - RNA, 19 nt, Artificial Sequence
  siRNA Sense Sequence
auguuggccaggauggucu

SEQ ID NO: 4331 - RNA, 19 nt, Artificial Sequence
  siRNA Antisense Sequence
agaccauccuggccaacau

SEQ ID NO: 4332 - RNA, 19 nt, Artificial Sequence
  siRNA Sense Sequence
uguuggccaggauggucuc

SEQ ID NO: 4333 - RNA, 19 nt, Artificial Sequence
  siRNA Antisense Sequence
gagaccauccuggccaaca

SEQ ID NO: 4334 - RNA, 19 nt, Artificial Sequence
  siRNA Sense Sequence
guuggccaggauggucuca

SEQ ID NO: 4335 - RNA, 19 nt, Artificial Sequence
  siRNA Antisense Sequence
ugagaccauccuggccaac

SEQ ID NO: 4336 - RNA, 19 nt, Artificial Sequence
  siRNA Sense Sequence
uuggccaggauggucucaa

SEQ ID NO: 4337 - RNA, 19 nt, Artificial Sequence
  siRNA Antisense Sequence
uugagaccauccuggccaa

SEQ ID NO: 4338 - RNA, 19 nt, Artificial Sequence
  siRNA Sense Sequence
uggccaggauggucucaau

SEQ ID NO: 4339 - RNA, 19 nt, Artificial Sequence
  siRNA Antisense Sequence
auugagaccauccuggcca

SEQ ID NO: 4340 - RNA, 19 nt, Artificial Sequence
  siRNA Sense Sequence
ggccaggauggucucaauc

SEQ ID NO: 4341 - RNA, 19 nt, Artificial Sequence
  siRNA Antisense Sequence
gauugagaccauccuggcc

SEQ ID NO: 4342 - RNA, 19 nt, Artificial Sequence
  siRNA Sense Sequence
gccaggauggucucaaucu

SEQ ID NO: 4343 - RNA, 19 nt, Artificial Sequence
  siRNA Antisense Sequence
agauugagaccauccuggc

SEQ ID NO: 4344 - RNA, 19 nt, Artificial Sequence
  siRNA Sense Sequence
ccaggauggucucaaucuc

SEQ ID NO: 4345 - RNA, 19 nt, Artificial Sequence
  siRNA Antisense Sequence
gagauugagaccauccugg

SEQ ID NO: 4346 - RNA, 19 nt, Artificial Sequence
  siRNA Sense Sequence
caggauggucucaaucucu

SEQ ID NO: 4347 - RNA, 19 nt, Artificial Sequence
  siRNA Antisense Sequence
agagauugagaccauccug

SEQ ID NO: 4348 - RNA, 19 nt, Artificial Sequence
  siRNA Sense Sequence
aggauggucucaaucucuu

SEQ ID NO: 4349 - RNA, 19 nt, Artificial Sequence
  siRNA Antisense Sequence
aagagauugagaccauccu

SEQ ID NO: 4350 - RNA, 19 nt, Artificial Sequence
  siRNA Sense Sequence
auuauaggcgugagccacc

SEQ ID NO: 4351 - RNA, 19 nt, Artificial Sequence
  siRNA Antisense Sequence
gguggcucacgccuauaau

SEQ ID NO: 4352 - RNA, 19 nt, Artificial Sequence
  siRNA Sense Sequence
uuauaggcgugagccaccg

SEQ ID NO: 4353 - RNA, 19 nt, Artificial Sequence
  siRNA Antisense Sequence
cgguggcucacgccuauaa

SEQ ID NO: 4354 - RNA, 19 nt, Artificial Sequence
  siRNA Sense Sequence
uauaggcgugagccaccgc

SEQ ID NO: 4355 - RNA, 19 nt, Artificial Sequence
  siRNA Antisense Sequence
gcgguggcucacgccuaua

SEQ ID NO: 4356 - RNA, 19 nt, Artificial Sequence
  siRNA Sense Sequence
gcgccuggcuuauacuuuc

SEQ ID NO: 4357 - RNA, 19 nt, Artificial Sequence
  siRNA Antisense Sequence
gaaaguauaagccaggcgc

SEQ ID NO: 4358 - RNA, 19 nt, Artificial Sequence
  siRNA Sense Sequence
cgccuggcuuauacuuucu

SEQ ID NO: 4359 - RNA, 19 nt, Artificial Sequence
  siRNA Antisense Sequence
agaaaguauaagccaggcg

SEQ ID NO: 4360 - RNA, 19 nt, Artificial Sequence
  siRNA Sense Sequence
ccuggcuuauacuuucuua

SEQ ID NO: 4361 - RNA, 19 nt, Artificial Sequence
  siRNA Antisense Sequence
uaagaaaguauaagccagg

SEQ ID NO: 4362 - RNA, 19 nt, Artificial Sequence
  siRNA Sense Sequence
cuggcuuauacuuucuuaa

SEQ ID NO: 4363 - RNA, 19 nt, Artificial Sequence
  siRNA Antisense Sequence
uuaagaaaguauaagccag

SEQ ID NO: 4364 - RNA, 19 nt, Artificial Sequence
  siRNA Sense Sequence
caaaugugagucauaaaga

SEQ ID NO: 4365 - RNA, 19 nt, Artificial Sequence
  siRNA Antisense Sequence
ucuuuaugacucacauuug

SEQ ID NO: 4366 - RNA, 19 nt, Artificial Sequence
  siRNA Sense Sequence
aaugugagucauaaagaag

SEQ ID NO: 4367 - RNA, 19 nt, Artificial Sequence
  siRNA Antisense Sequence
cuucuuuaugacucacauu

SEQ ID NO: 4368 - RNA, 19 nt, Artificial Sequence
  siRNA Sense Sequence
ugagucauaaagaaggguu

SEQ ID NO: 4369 - RNA, 19 nt, Artificial Sequence
  siRNA Antisense Sequence
aacccuucuuuaugacuca

SEQ ID NO: 4370 - RNA, 19 nt, Artificial Sequence
  siRNA Sense Sequence
agucauaaagaaggguuag

SEQ ID NO: 4371 - RNA, 19 nt, Artificial Sequence
  siRNA Antisense Sequence
cuaacccuucuuuaugacu

SEQ ID NO: 4372 - RNA, 19 nt, Artificial Sequence
  siRNA Sense Sequence
gucauaaagaaggguuagg

SEQ ID NO: 4373 - RNA, 19 nt, Artificial Sequence
  siRNA Antisense Sequence
ccuaacccuucuuuaugac

SEQ ID NO: 4374 - RNA, 19 nt, Artificial Sequence
  siRNA Sense Sequence
ucauaaagaaggguuaggg

SEQ ID NO: 4375 - RNA, 19 nt, Artificial Sequence
  siRNA Antisense Sequence
cccuaacccuucuuuauga

SEQ ID NO: 4376 - RNA, 19 nt, Artificial Sequence
  siRNA Sense Sequence
cauaaagaaggguuagggu

SEQ ID NO: 4377 - RNA, 19 nt, Artificial Sequence
  siRNA Antisense Sequence
acccuaacccuucuuuaug

SEQ ID NO: 4378 - RNA, 19 nt, Artificial Sequence
  siRNA Sense Sequence
aagaaggguuagggugaug

SEQ ID NO: 4379 - RNA, 19 nt, Artificial Sequence
  siRNA Antisense Sequence
caucacccuaacccuucuu

SEQ ID NO: 4380 - RNA, 19 nt, Artificial Sequence
  siRNA Sense Sequence
agaaggguuagggugaugg

SEQ ID NO: 4381 - RNA, 19 nt, Artificial Sequence
  siRNA Antisense Sequence
ccaucacccuaacccuucu

SEQ ID NO: 4382 - RNA, 19 nt, Artificial Sequence
  siRNA Sense Sequence
gaaggguuagggugauggu

SEQ ID NO: 4383 - RNA, 19 nt, Artificial Sequence
  siRNA Antisense Sequence
accaucacccuaacccuuc

SEQ ID NO: 4384 - RNA, 19 nt, Artificial Sequence
  siRNA Sense Sequence
aaggguuagggugaugguc

SEQ ID NO: 4385 - RNA, 19 nt, Artificial Sequence
  siRNA Antisense Sequence
gaccaucacccuaacccuu

SEQ ID NO: 4386 - RNA, 19 nt, Artificial Sequence
  siRNA Sense Sequence
aggguuagggugauggucc

SEQ ID NO: 4387 - RNA, 19 nt, Artificial Sequence
  siRNA Antisense Sequence
ggaccaucacccuaacccu

SEQ ID NO: 4388 - RNA, 19 nt, Artificial Sequence
  siRNA Sense Sequence
ggguuagggugauggucca

SEQ ID NO: 4389 - RNA, 19 nt, Artificial Sequence
  siRNA Antisense Sequence
uggaccaucacccuaaccc

SEQ ID NO: 4390 - RNA, 19 nt, Artificial Sequence
  siRNA Sense Sequence
gggugaugguccagagcaa

SEQ ID NO: 4391 - RNA, 19 nt, Artificial Sequence
  siRNA Antisense Sequence
uugcucuggaccaucaccc

SEQ ID NO: 4392 - RNA, 19 nt, Artificial Sequence
  siRNA Sense Sequence
ggugaugguccagagcaac

SEQ ID NO: 4393 - RNA, 19 nt, Artificial Sequence
  siRNA Antisense Sequence
guugcucuggaccaucacc

SEQ ID NO: 4394 - RNA, 19 nt, Artificial Sequence
  siRNA Sense Sequence
acaguucuucaaguguacu

SEQ ID NO: 4395 - RNA, 19 nt, Artificial Sequence
  siRNA Antisense Sequence
aguacacuugaagaacugu

SEQ ID NO: 4396 - RNA, 19 nt, Artificial Sequence
  siRNA Sense Sequence
caguucuucaaguguacuc

SEQ ID NO: 4397 - RNA, 19 nt, Artificial Sequence
  siRNA Antisense Sequence
gaguacacuugaagaacug

SEQ ID NO: 4398 - RNA, 19 nt, Artificial Sequence
  siRNA Sense Sequence
aguucuucaaguguacucu

SEQ ID NO: 4399 - RNA, 19 nt, Artificial Sequence
  siRNA Antisense Sequence
agaguacacuugaagaacu

SEQ ID NO: 4400 - RNA, 19 nt, Artificial Sequence
  siRNA Sense Sequence
caaguguacucuguaggcu

SEQ ID NO: 4401 - RNA, 19 nt, Artificial Sequence
  siRNA Antisense Sequence
agccuacagaguacacuug

SEQ ID NO: 4402 - RNA, 19 nt, Artificial Sequence
  siRNA Sense Sequence
aaguguacucuguaggcuu

SEQ ID NO: 4403 - RNA, 19 nt, Artificial Sequence
  siRNA Antisense Sequence
aagccuacagaguacacuu

SEQ ID NO: 4404 - RNA, 19 nt, Artificial Sequence
  siRNA Sense Sequence
guguacucuguaggcuucu

SEQ ID NO: 4405 - RNA, 19 nt, Artificial Sequence
  siRNA Antisense Sequence
agaagccuacagaguacac

SEQ ID NO: 4406 - RNA, 19 nt, Artificial Sequence
  siRNA Sense Sequence
uguacucuguaggcuucug

SEQ ID NO: 4407 - RNA, 19 nt, Artificial Sequence
  siRNA Antisense Sequence
cagaagccuacagaguaca

SEQ ID NO: 4408 - RNA, 19 nt, Artificial Sequence
  siRNA Sense Sequence
guacucuguaggcuucugg

SEQ ID NO: 4409 - RNA, 19 nt, Artificial Sequence
  siRNA Antisense Sequence
ccagaagccuacagaguac

SEQ ID NO: 4410 - RNA, 19 nt, Artificial Sequence
  siRNA Sense Sequence
uacucuguaggcuucuggg

SEQ ID NO: 4411 - RNA, 19 nt, Artificial Sequence
  siRNA Antisense Sequence
cccagaagccuacagagua

SEQ ID NO: 4412 - RNA, 19 nt, Artificial Sequence
  siRNA Sense Sequence
guaggcuucugggaggucc

SEQ ID NO: 4413 - RNA, 19 nt, Artificial Sequence
  siRNA Antisense Sequence
ggaccucccagaagccuac

SEQ ID NO: 4414 - RNA, 19 nt, Artificial Sequence
  siRNA Sense Sequence
uaggcuucugggagguccc

SEQ ID NO: 4415 - RNA, 19 nt, Artificial Sequence
  siRNA Antisense Sequence
gggaccucccagaagccua

SEQ ID NO: 4416 - RNA, 19 nt, Artificial Sequence
  siRNA Sense Sequence
aggcuucugggaggucccu

SEQ ID NO: 4417 - RNA, 19 nt, Artificial Sequence
  siRNA Antisense Sequence
agggaccucccagaagccu

SEQ ID NO: 4418 - RNA, 19 nt, Artificial Sequence
  siRNA Sense Sequence
ggcuucugggaggucccuu

SEQ ID NO: 4419 - RNA, 19 nt, Artificial Sequence
  siRNA Antisense Sequence
aagggaccucccagaagcc

SEQ ID NO: 4420 - RNA, 19 nt, Artificial Sequence
  siRNA Sense Sequence
gcuucugggaggucccuuu

SEQ ID NO: 4421 - RNA, 19 nt, Artificial Sequence
  siRNA Antisense Sequence
aaagggaccucccagaagc

SEQ ID NO: 4422 - RNA, 19 nt, Artificial Sequence
  siRNA Sense Sequence
cuucugggaggucccuuuu

SEQ ID NO: 4423 - RNA, 19 nt, Artificial Sequence
  siRNA Antisense Sequence
aaaagggaccucccagaag

SEQ ID NO: 4424 - RNA, 19 nt, Artificial Sequence
  siRNA Sense Sequence
uucugggaggucccuuuuc

SEQ ID NO: 4425 - RNA, 19 nt, Artificial Sequence
  siRNA Antisense Sequence
gaaaagggaccucccagaa

SEQ ID NO: 4426 - RNA, 19 nt, Artificial Sequence
  siRNA Sense Sequence
ucugggaggucccuuuuca

SEQ ID NO: 4427 - RNA, 19 nt, Artificial Sequence
  siRNA Antisense Sequence
ugaaaagggaccucccaga

SEQ ID NO: 4428 - RNA, 19 nt, Artificial Sequence
  siRNA Sense Sequence
cauguuauuugccuuuuga

SEQ ID NO: 4429 - RNA, 19 nt, Artificial Sequence
  siRNA Antisense Sequence
ucaaaaggcaaauaacaug

SEQ ID NO: 4430 - RNA, 19 nt, Artificial Sequence
  siRNA Sense Sequence
auuugccuuuugaauucuc

SEQ ID NO: 4431 - RNA, 19 nt, Artificial Sequence
  siRNA Antisense Sequence
gagaauucaaaaggcaaau

SEQ ID NO: 4432 - RNA, 19 nt, Artificial Sequence
  siRNA Sense Sequence
uuugccuuuugaauucuca

SEQ ID NO: 4433 - RNA, 19 nt, Artificial Sequence
  siRNA Antisense Sequence
ugagaauucaaaaggcaaa

SEQ ID NO: 4434 - RNA, 19 nt, Artificial Sequence
  siRNA Sense Sequence
uugccuuuugaauucucau

SEQ ID NO: 4435 - RNA, 19 nt, Artificial Sequence
  siRNA Antisense Sequence
augagaauucaaaaggcaa

SEQ ID NO: 4436 - RNA, 19 nt, Artificial Sequence
  siRNA Sense Sequence
ugccuuuugaauucucauu

SEQ ID NO: 4437 - RNA, 19 nt, Artificial Sequence
  siRNA Antisense Sequence
aaugagaauucaaaaggca

SEQ ID NO: 4438 - RNA, 19 nt, Artificial Sequence
  siRNA Sense Sequence
gccuuuugaauucucauua

SEQ ID NO: 4439 - RNA, 19 nt, Artificial Sequence
  siRNA Antisense Sequence
uaaugagaauucaaaaggc

SEQ ID NO: 4440 - RNA, 19 nt, Artificial Sequence
  siRNA Sense Sequence
auuguauuguggaguuuuc

SEQ ID NO: 4441 - RNA, 19 nt, Artificial Sequence
  siRNA Antisense Sequence
gaaaacuccacaauacaau

SEQ ID NO: 4442 - RNA, 19 nt, Artificial Sequence
  siRNA Sense Sequence
uuguauuguggaguuuucc

SEQ ID NO: 4443 - RNA, 19 nt, Artificial Sequence
  siRNA Antisense Sequence
ggaaaacuccacaauacaa

SEQ ID NO: 4444 - RNA, 19 nt, Artificial Sequence
  siRNA Sense Sequence
aguuuuccagaggccgugu

SEQ ID NO: 4445 - RNA, 19 nt, Artificial Sequence
  siRNA Antisense Sequence
acacggccucuggaaaacu

SEQ ID NO: 4446 - RNA, 19 nt, Artificial Sequence
  siRNA Sense Sequence
guuuuccagaggccgugug

SEQ ID NO: 4447 - RNA, 19 nt, Artificial Sequence
  siRNA Antisense Sequence
cacacggccucuggaaaac

SEQ ID NO: 4448 - RNA, 19 nt, Artificial Sequence
  siRNA Sense Sequence
uuuuccagaggccguguga

SEQ ID NO: 4449 - RNA, 19 nt, Artificial Sequence
  siRNA Antisense Sequence
ucacacggccucuggaaaa

SEQ ID NO: 4450 - RNA, 19 nt, Artificial Sequence
  siRNA Sense Sequence
uuuccagaggccgugugac

SEQ ID NO: 4451 - RNA, 19 nt, Artificial Sequence
  siRNA Antisense Sequence
gucacacggccucuggaaa

SEQ ID NO: 4452 - RNA, 19 nt, Artificial Sequence
  siRNA Sense Sequence
uuccagaggccgugugaca

SEQ ID NO: 4453 - RNA, 19 nt, Artificial Sequence
  siRNA Antisense Sequence
ugucacacggccucuggaa

SEQ ID NO: 4454 - RNA, 19 nt, Artificial Sequence
  siRNA Sense Sequence
uccagaggccgugugacau

SEQ ID NO: 4455 - RNA, 19 nt, Artificial Sequence
  siRNA Antisense Sequence
augucacacggccucugga

SEQ ID NO: 4456 - RNA, 19 nt, Artificial Sequence
  siRNA Sense Sequence
ccagaggccgugugacaug

SEQ ID NO: 4457 - RNA, 19 nt, Artificial Sequence
  siRNA Antisense Sequence
caugucacacggccucugg

SEQ ID NO: 4458 - RNA, 19 nt, Artificial Sequence
  siRNA Sense Sequence
cagaggccgugugacaugu

SEQ ID NO: 4459 - RNA, 19 nt, Artificial Sequence
  siRNA Antisense Sequence
acaugucacacggccucug

SEQ ID NO: 4460 - RNA, 19 nt, Artificial Sequence
  siRNA Sense Sequence
agaggccgugugacaugug

SEQ ID NO: 4461 - RNA, 19 nt, Artificial Sequence
  siRNA Antisense Sequence
cacaugucacacggccucu

SEQ ID NO: 4462 - RNA, 19 nt, Artificial Sequence
  siRNA Sense Sequence
gccgugugacaugugauua

SEQ ID NO: 4463 - RNA, 19 nt, Artificial Sequence
  siRNA Antisense Sequence
uaaucacaugucacacggc

SEQ ID NO: 4464 - RNA, 19 nt, Artificial Sequence
  siRNA Sense Sequence
ccgugugacaugugauuac

SEQ ID NO: 4465 - RNA, 19 nt, Artificial Sequence
  siRNA Antisense Sequence
guaaucacaugucacacgg

SEQ ID NO: 4466 - RNA, 19 nt, Artificial Sequence
  siRNA Sense Sequence
cgugugacaugugauuaca

SEQ ID NO: 4467 - RNA, 19 nt, Artificial Sequence
  siRNA Antisense Sequence
uguaaucacaugucacacg

SEQ ID NO: 4468 - RNA, 19 nt, Artificial Sequence
  siRNA Sense Sequence
gauuacaucaucuuucuga

SEQ ID NO: 4469 - RNA, 19 nt, Artificial Sequence
  siRNA Antisense Sequence
ucagaaagaugauguaauc

SEQ ID NO: 4470 - RNA, 19 nt, Artificial Sequence
  siRNA Sense Sequence
auuacaucaucuuucugac

SEQ ID NO: 4471 - RNA, 19 nt, Artificial Sequence
  siRNA Antisense Sequence
gucagaaagaugauguaau

SEQ ID NO: 4472 - RNA, 19 nt, Artificial Sequence
  siRNA Sense Sequence
uuacaucaucuuucugaca

SEQ ID NO: 4473 - RNA, 19 nt, Artificial Sequence
  siRNA Antisense Sequence
ugucagaaagaugauguaa

SEQ ID NO: 4474 - RNA, 19 nt, Artificial Sequence
  siRNA Sense Sequence
uacaucaucuuucugacau

SEQ ID NO: 4475 - RNA, 19 nt, Artificial Sequence
  siRNA Antisense Sequence
augucagaaagaugaugua

SEQ ID NO: 4476 - RNA, 19 nt, Artificial Sequence
  siRNA Sense Sequence
aucuuucugacaucauugu

SEQ ID NO: 4477 - RNA, 19 nt, Artificial Sequence
  siRNA Antisense Sequence
acaaugaugucagaaagau

SEQ ID NO: 4478 - RNA, 19 nt, Artificial Sequence
  siRNA Sense Sequence
auuguuaauggaaugugug

SEQ ID NO: 4479 - RNA, 19 nt, Artificial Sequence
  siRNA Antisense Sequence
cacacauuccauuaacaau

SEQ ID NO: 4480 - RNA, 19 nt, Artificial Sequence
  siRNA Sense Sequence
gaaugugugcuuguauggu

SEQ ID NO: 4481 - RNA, 19 nt, Artificial Sequence
  siRNA Antisense Sequence
accauacaagcacacauuc

SEQ ID NO: 4482 - RNA, 19 nt, Artificial Sequence
  siRNA Sense Sequence
aaugugugcuuguaugguc

SEQ ID NO: 4483 - RNA, 19 nt, Artificial Sequence
  siRNA Antisense Sequence
gaccauacaagcacacauu

SEQ ID NO: 4484 - RNA, 19 nt, Artificial Sequence
  siRNA Sense Sequence
augugugcuuguauggucu

SEQ ID NO: 4485 - RNA, 19 nt, Artificial Sequence
  siRNA Antisense Sequence
agaccauacaagcacacau

SEQ ID NO: 4486 - RNA, 19 nt, Artificial Sequence
  siRNA Sense Sequence
ugugugcuuguauggucuu

SEQ ID NO: 4487 - RNA, 19 nt, Artificial Sequence
  siRNA Antisense Sequence
aagaccauacaagcacaca

SEQ ID NO: 4488 - RNA, 19 nt, Artificial Sequence
  siRNA Sense Sequence
gugugcuuguauggucuug

SEQ ID NO: 4489 - RNA, 19 nt, Artificial Sequence
  siRNA Antisense Sequence
caagaccauacaagcacac

SEQ ID NO: 4490 - RNA, 19 nt, Artificial Sequence
  siRNA Sense Sequence
ugugcuuguauggucuugu

SEQ ID NO: 4491 - RNA, 19 nt, Artificial Sequence
  siRNA Antisense Sequence
acaagaccauacaagcaca

SEQ ID NO: 4492 - RNA, 19 nt, Artificial Sequence
  siRNA Sense Sequence
gugcuuguauggucuugug

SEQ ID NO: 4493 - RNA, 19 nt, Artificial Sequence
  siRNA Antisense Sequence
cacaagaccauacaagcac

SEQ ID NO: 4494 - RNA, 19 nt, Artificial Sequence
  siRNA Sense Sequence
ugcuuguauggucuugugu

SEQ ID NO: 4495 - RNA, 19 nt, Artificial Sequence
  siRNA Antisense Sequence
acacaagaccauacaagca

SEQ ID NO: 4496 - RNA, 19 nt, Artificial Sequence
  siRNA Sense Sequence
gcuuguauggucuuguguu

SEQ ID NO: 4497 - RNA, 19 nt, Artificial Sequence
  siRNA Antisense Sequence
aacacaagaccauacaagc

SEQ ID NO: 4498 - RNA, 19 nt, Artificial Sequence
  siRNA Sense Sequence
cuuguauggucuuguguua

SEQ ID NO: 4499 - RNA, 19 nt, Artificial Sequence
  siRNA Antisense Sequence
uaacacaagaccauacaag

SEQ ID NO: 4500 - RNA, 19 nt, Artificial Sequence
  siRNA Sense Sequence
uauggucuuguguuacagu

SEQ ID NO: 4501 - RNA, 19 nt, Artificial Sequence
  siRNA Antisense Sequence
acuguaacacaagaccaua

SEQ ID NO: 4502 - RNA, 19 nt, Artificial Sequence
  siRNA Sense Sequence
auggucuuguguuacaguc

SEQ ID NO: 4503 - RNA, 19 nt, Artificial Sequence
  siRNA Antisense Sequence
gacuguaacacaagaccau

SEQ ID NO: 4504 - RNA, 19 nt, Artificial Sequence
  siRNA Sense Sequence
agucucgcucugucgccca

SEQ ID NO: 4505 - RNA, 19 nt, Artificial Sequence
  siRNA Antisense Sequence
ugggcgacagagcgagacu

SEQ ID NO: 4506 - RNA, 19 nt, Artificial Sequence
  siRNA Sense Sequence
caaucucggcucacugcaa

SEQ ID NO: 4507 - RNA, 19 nt, Artificial Sequence
  siRNA Antisense Sequence
uugcagugagccgagauug

SEQ ID NO: 4508 - RNA, 19 nt, Artificial Sequence
  siRNA Sense Sequence
aaucucggcucacugcaac

SEQ ID NO: 4509 - RNA, 19 nt, Artificial Sequence
  siRNA Antisense Sequence
guugcagugagccgagauu

SEQ ID NO: 4510 - RNA, 19 nt, Artificial Sequence
  siRNA Sense Sequence
aucucggcucacugcaacc

SEQ ID NO: 4511 - RNA, 19 nt, Artificial Sequence
  siRNA Antisense Sequence
gguugcagugagccgagau

SEQ ID NO: 4512 - RNA, 19 nt, Artificial Sequence
  siRNA Sense Sequence
ucucggcucacugcaaccu

SEQ ID NO: 4513 - RNA, 19 nt, Artificial Sequence
  siRNA Antisense Sequence
agguugcagugagccgaga

SEQ ID NO: 4514 - RNA, 19 nt, Artificial Sequence
  siRNA Sense Sequence
cucacugcaaccuccaccu

SEQ ID NO: 4515 - RNA, 19 nt, Artificial Sequence
  siRNA Antisense Sequence
agguggagguugcagugag

SEQ ID NO: 4516 - RNA, 19 nt, Artificial Sequence
  siRNA Sense Sequence
ucacugcaaccuccaccuc

SEQ ID NO: 4517 - RNA, 19 nt, Artificial Sequence
  siRNA Antisense Sequence
gagguggagguugcaguga

SEQ ID NO: 4518 - RNA, 19 nt, Artificial Sequence
  siRNA Sense Sequence
cacugcaaccuccaccucc

SEQ ID NO: 4519 - RNA, 19 nt, Artificial Sequence
  siRNA Antisense Sequence
ggagguggagguugcagug

SEQ ID NO: 4520 - RNA, 19 nt, Artificial Sequence
  siRNA Sense Sequence
acugcaaccuccaccuccc

SEQ ID NO: 4521 - RNA, 19 nt, Artificial Sequence
  siRNA Antisense Sequence
gggagguggagguugcagu

SEQ ID NO: 4522 - RNA, 19 nt, Artificial Sequence
  siRNA Sense Sequence
agccuccugaguagcuggg

SEQ ID NO: 4523 - RNA, 19 nt, Artificial Sequence
  siRNA Antisense Sequence
cccagcuacucaggaggcu

SEQ ID NO: 4524 - RNA, 19 nt, Artificial Sequence
  siRNA Sense Sequence
gccuccugaguagcuggga

SEQ ID NO: 4525 - RNA, 19 nt, Artificial Sequence
  siRNA Antisense Sequence
ucccagcuacucaggaggc

SEQ ID NO: 4526 - RNA, 19 nt, Artificial Sequence
  siRNA Sense Sequence
ccuccugaguagcugggac

SEQ ID NO: 4527 - RNA, 19 nt, Artificial Sequence
  siRNA Antisense Sequence
gucccagcuacucaggagg

SEQ ID NO: 4528 - RNA, 19 nt, Artificial Sequence
  siRNA Sense Sequence
cuccugaguagcugggacu

SEQ ID NO: 4529 - RNA, 19 nt, Artificial Sequence
  siRNA Antisense Sequence
agucccagcuacucaggag

SEQ ID NO: 4530 - RNA, 19 nt, Artificial Sequence
  siRNA Sense Sequence
uccugaguagcugggacua

SEQ ID NO: 4531 - RNA, 19 nt, Artificial Sequence
  siRNA Antisense Sequence
uagucccagcuacucagga

SEQ ID NO: 4532 - RNA, 19 nt, Artificial Sequence
  siRNA Sense Sequence
uagcugggacuacaggccu

SEQ ID NO: 4533 - RNA, 19 nt, Artificial Sequence
  siRNA Antisense Sequence
aggccuguagucccagcua

SEQ ID NO: 4534 - RNA, 19 nt, Artificial Sequence
  siRNA Sense Sequence
agcugggacuacaggccug

SEQ ID NO: 4535 - RNA, 19 nt, Artificial Sequence
  siRNA Antisense Sequence
caggccuguagucccagcu

SEQ ID NO: 4536 - RNA, 19 nt, Artificial Sequence
  siRNA Sense Sequence
gccaccaugcccagcuauu

SEQ ID NO: 4537 - RNA, 19 nt, Artificial Sequence
  siRNA Antisense Sequence
aauagcugggcaugguggc

SEQ ID NO: 4538 - RNA, 19 nt, Artificial Sequence
  siRNA Sense Sequence
ccaccaugcccagcuauuu

SEQ ID NO: 4539 - RNA, 19 nt, Artificial Sequence
  siRNA Antisense Sequence
aaauagcugggcauggugg

SEQ ID NO: 4540 - RNA, 19 nt, Artificial Sequence
  siRNA Sense Sequence
caccaugcccagcuauuuu

SEQ ID NO: 4541 - RNA, 19 nt, Artificial Sequence
  siRNA Antisense Sequence
aaaauagcugggcauggug

SEQ ID NO: 4542 - RNA, 19 nt, Artificial Sequence
  siRNA Sense Sequence
ggguuucaccauguuggcc

SEQ ID NO: 4543 - RNA, 19 nt, Artificial Sequence
  siRNA Antisense Sequence
ggccaacauggugaaaccc

SEQ ID NO: 4544 - RNA, 19 nt, Artificial Sequence
  siRNA Sense Sequence
gguuucaccauguuggcca

SEQ ID NO: 4545 - RNA, 19 nt, Artificial Sequence
  siRNA Antisense Sequence
uggccaacauggugaaacc

SEQ ID NO: 4546 - RNA, 19 nt, Artificial Sequence
  siRNA Sense Sequence
guuucaccauguuggccag

SEQ ID NO: 4547 - RNA, 19 nt, Artificial Sequence
  siRNA Antisense Sequence
cuggccaacauggugaaac

SEQ ID NO: 4548 - RNA, 19 nt, Artificial Sequence
  siRNA Sense Sequence
caccauguuggccaggcug

SEQ ID NO: 4549 - RNA, 19 nt, Artificial Sequence
  siRNA Antisense Sequence
cagccuggccaacauggug

SEQ ID NO: 4550 - RNA, 19 nt, Artificial Sequence
  siRNA Sense Sequence
accauguuggccaggcugg

SEQ ID NO: 4551 - RNA, 19 nt, Artificial Sequence
  siRNA Antisense Sequence
ccagccuggccaacauggu

SEQ ID NO: 4552 - RNA, 19 nt, Artificial Sequence
  siRNA Sense Sequence
ccauguuggccaggcuggu

SEQ ID NO: 4553 - RNA, 19 nt, Artificial Sequence
  siRNA Antisense Sequence
accagccuggccaacaugg

SEQ ID NO: 4554 - RNA, 19 nt, Artificial Sequence
  siRNA Sense Sequence
cauguuggccaggcugguc

SEQ ID NO: 4555 - RNA, 19 nt, Artificial Sequence
  siRNA Antisense Sequence
gaccagccuggccaacaug

SEQ ID NO: 4556 - RNA, 19 nt, Artificial Sequence
  siRNA Sense Sequence
auguuggccaggcuggucu

SEQ ID NO: 4557 - RNA, 19 nt, Artificial Sequence
  siRNA Antisense Sequence
agaccagccuggccaacau

SEQ ID NO: 4558 - RNA, 19 nt, Artificial Sequence
  siRNA Sense Sequence
uguuggccaggcuggucuc

SEQ ID NO: 4559 - RNA, 19 nt, Artificial Sequence
  siRNA Antisense Sequence
gagaccagccuggccaaca

SEQ ID NO: 4560 - RNA, 19 nt, Artificial Sequence
  siRNA Sense Sequence
cuugaggugauccgccugc

SEQ ID NO: 4561 - RNA, 19 nt, Artificial Sequence
  siRNA Antisense Sequence
gcaggcggaucaccucaag

SEQ ID NO: 4562 - RNA, 19 nt, Artificial Sequence
  siRNA Sense Sequence
uugaggugauccgccugcc

SEQ ID NO: 4563 - RNA, 19 nt, Artificial Sequence
  siRNA Antisense Sequence
ggcaggcggaucaccucaa

SEQ ID NO: 4564 - RNA, 19 nt, Artificial Sequence
  siRNA Sense Sequence
ugaggugauccgccugccu

SEQ ID NO: 4565 - RNA, 19 nt, Artificial Sequence
  siRNA Antisense Sequence
aggcaggcggaucaccuca

SEQ ID NO: 4566 - RNA, 19 nt, Artificial Sequence
  siRNA Sense Sequence
ccaaagugcugggauuaca

SEQ ID NO: 4567 - RNA, 19 nt, Artificial Sequence
  siRNA Antisense Sequence
uguaaucccagcacuuugg

SEQ ID NO: 4568 - RNA, 19 nt, Artificial Sequence
  siRNA Sense Sequence
caaagugcugggauuacag

SEQ ID NO: 4569 - RNA, 19 nt, Artificial Sequence
  siRNA Antisense Sequence
cuguaaucccagcacuuug

SEQ ID NO: 4570 - RNA, 19 nt, Artificial Sequence
  siRNA Sense Sequence
gugcugggauuacaggucu

SEQ ID NO: 4571 - RNA, 19 nt, Artificial Sequence
  siRNA Antisense Sequence
agaccuguaaucccagcac

SEQ ID NO: 4572 - RNA, 19 nt, Artificial Sequence
  siRNA Sense Sequence
ugcugggauuacaggucug

SEQ ID NO: 4573 - RNA, 19 nt, Artificial Sequence
  siRNA Antisense Sequence
cagaccuguaaucccagca

SEQ ID NO: 4574 - RNA, 19 nt, Artificial Sequence
  siRNA Sense Sequence
gcugggauuacaggucuga

SEQ ID NO: 4575 - RNA, 19 nt, Artificial Sequence
  siRNA Antisense Sequence
ucagaccuguaaucccagc

SEQ ID NO: 4576 - RNA, 19 nt, Artificial Sequence
  siRNA Sense Sequence
cugggauuacaggucugag

SEQ ID NO: 4577 - RNA, 19 nt, Artificial Sequence
  siRNA Antisense Sequence
cucagaccuguaaucccag

SEQ ID NO: 4578 - RNA, 19 nt, Artificial Sequence
  siRNA Sense Sequence
ggucugagccacugugccu

SEQ ID NO: 4579 - RNA, 19 nt, Artificial Sequence
  siRNA Antisense Sequence
aggcacaguggcucagacc

SEQ ID NO: 4580 - RNA, 19 nt, Artificial Sequence
  siRNA Sense Sequence
gucugagccacugugccua

SEQ ID NO: 4581 - RNA, 19 nt, Artificial Sequence
  siRNA Antisense Sequence
uaggcacaguggcucagac

SEQ ID NO: 4582 - RNA, 19 nt, Artificial Sequence
  siRNA Sense Sequence
ucugagccacugugccuaa

SEQ ID NO: 4583 - RNA, 19 nt, Artificial Sequence
  siRNA Antisense Sequence
uuaggcacaguggcucaga

SEQ ID NO: 4584 - RNA, 19 nt, Artificial Sequence
  siRNA Sense Sequence
cugagccacugugccuaac

SEQ ID NO: 4585 - RNA, 19 nt, Artificial Sequence
  siRNA Antisense Sequence
guuaggcacaguggcucag

SEQ ID NO: 4586 - RNA, 19 nt, Artificial Sequence
  siRNA Sense Sequence
ugagccacugugccuaacc

SEQ ID NO: 4587 - RNA, 19 nt, Artificial Sequence
  siRNA Antisense Sequence
gguuaggcacaguggcuca

SEQ ID NO: 4588 - RNA, 19 nt, Artificial Sequence
  siRNA Sense Sequence
cacugugccuaaccuaaug

SEQ ID NO: 4589 - RNA, 19 nt, Artificial Sequence
  siRNA Antisense Sequence
cauuagguuaggcacagug

SEQ ID NO: 4590 - RNA, 19 nt, Artificial Sequence
  siRNA Sense Sequence
acugugccuaaccuaauga

SEQ ID NO: 4591 - RNA, 19 nt, Artificial Sequence
  siRNA Antisense Sequence
ucauuagguuaggcacagu

SEQ ID NO: 4592 - RNA, 19 nt, Artificial Sequence
  siRNA Sense Sequence
cugugccuaaccuaaugac

SEQ ID NO: 4593 - RNA, 19 nt, Artificial Sequence
  siRNA Antisense Sequence
gucauuagguuaggcacag

SEQ ID NO: 4594 - RNA, 19 nt, Artificial Sequence
  siRNA Sense Sequence
ugugccuaaccuaaugacu

SEQ ID NO: 4595 - RNA, 19 nt, Artificial Sequence
  siRNA Antisense Sequence
agucauuagguuaggcaca

SEQ ID NO: 4596 - RNA, 19 nt, Artificial Sequence
  siRNA Sense Sequence
gugccuaaccuaaugacuu

SEQ ID NO: 4597 - RNA, 19 nt, Artificial Sequence
  siRNA Antisense Sequence
aagucauuagguuaggcac

SEQ ID NO: 4598 - RNA, 19 nt, Artificial Sequence
  siRNA Sense Sequence
ugccuaaccuaaugacuuu

SEQ ID NO: 4599 - RNA, 19 nt, Artificial Sequence
  siRNA Antisense Sequence
aaagucauuagguuaggca

SEQ ID NO: 4600 - RNA, 19 nt, Artificial Sequence
  siRNA Sense Sequence
gccuaaccuaaugacuuuu

SEQ ID NO: 4601 - RNA, 19 nt, Artificial Sequence
  siRNA Antisense Sequence
aaaagucauuagguuaggc

SEQ ID NO: 4602 - RNA, 19 nt, Artificial Sequence
  siRNA Sense Sequence
ccuaaccuaaugacuuuua

SEQ ID NO: 4603 - RNA, 19 nt, Artificial Sequence
  siRNA Antisense Sequence
uaaaagucauuagguuagg

SEQ ID NO: 4604 - RNA, 19 nt, Artificial Sequence
  siRNA Sense Sequence
accuaaugacuuuuaagag

SEQ ID NO: 4605 - RNA, 19 nt, Artificial Sequence
  siRNA Antisense Sequence
cucuuaaaagucauuaggu

SEQ ID NO: 4606 - RNA, 19 nt, Artificial Sequence
  siRNA Sense Sequence
cuuuuaagaguauagagga

SEQ ID NO: 4607 - RNA, 19 nt, Artificial Sequence
  siRNA Antisense Sequence
uccucuauacucuuaaaag

SEQ ID NO: 4608 - RNA, 19 nt, Artificial Sequence
  siRNA Sense Sequence
gacucacuggucuauagaa

SEQ ID NO: 4609 - RNA, 19 nt, Artificial Sequence
  siRNA Antisense Sequence
uucuauagaccagugaguc

SEQ ID NO: 4610 - RNA, 19 nt, Artificial Sequence
  siRNA Sense Sequence
aaaguaagguguucuaaga

SEQ ID NO: 4611 - RNA, 19 nt, Artificial Sequence
  siRNA Antisense Sequence
ucuuagaacaccuuacuuu

SEQ ID NO: 4612 - RNA, 19 nt, Artificial Sequence
  siRNA Sense Sequence
gagcucuucuugcugggca

SEQ ID NO: 4613 - RNA, 19 nt, Artificial Sequence
  siRNA Antisense Sequence
ugcccagcaagaagagcuc

SEQ ID NO: 4614 - RNA, 19 nt, Artificial Sequence
  siRNA Sense Sequence
agcucuucuugcugggcac

SEQ ID NO: 4615 - RNA, 19 nt, Artificial Sequence
  siRNA Antisense Sequence
gugcccagcaagaagagcu

SEQ ID NO: 4616 - RNA, 19 nt, Artificial Sequence
  siRNA Sense Sequence
gcucuucuugcugggcacc

SEQ ID NO: 4617 - RNA, 19 nt, Artificial Sequence
  siRNA Antisense Sequence
ggugcccagcaagaagagc

SEQ ID NO: 4618 - RNA, 19 nt, Artificial Sequence
  siRNA Sense Sequence
cucuucuugcugggcaccg

SEQ ID NO: 4619 - RNA, 19 nt, Artificial Sequence
  siRNA Antisense Sequence
cggugcccagcaagaagag

SEQ ID NO: 4620 - RNA, 19 nt, Artificial Sequence
  siRNA Sense Sequence
ucuucuugcugggcaccgg

SEQ ID NO: 4621 - RNA, 19 nt, Artificial Sequence
  siRNA Antisense Sequence
ccggugcccagcaagaaga

SEQ ID NO: 4622 - RNA, 19 nt, Artificial Sequence
  siRNA Sense Sequence
cuucuugcugggcaccggu

SEQ ID NO: 4623 - RNA, 19 nt, Artificial Sequence
  siRNA Antisense Sequence
accggugcccagcaagaag

SEQ ID NO: 4624 - RNA, 19 nt, Artificial Sequence
  siRNA Sense Sequence
uucuugcugggcaccggug

SEQ ID NO: 4625 - RNA, 19 nt, Artificial Sequence
  siRNA Antisense Sequence
caccggugcccagcaagaa

SEQ ID NO: 4626 - RNA, 19 nt, Artificial Sequence
  siRNA Sense Sequence
cccaggaguucgaggcuau

SEQ ID NO: 4627 - RNA, 19 nt, Artificial Sequence
  siRNA Antisense Sequence
auagccucgaacuccuggg

SEQ ID NO: 4628 - RNA, 19 nt, Artificial Sequence
  siRNA Sense Sequence
ccaggaguucgaggcuaug

SEQ ID NO: 4629 - RNA, 19 nt, Artificial Sequence
  siRNA Antisense Sequence
cauagccucgaacuccugg

SEQ ID NO: 4630 - RNA, 19 nt, Artificial Sequence
  siRNA Sense Sequence
aguucgaggcuaugaucac

SEQ ID NO: 4631 - RNA, 19 nt, Artificial Sequence
  siRNA Antisense Sequence
gugaucauagccucgaacu

SEQ ID NO: 4632 - RNA, 19 nt, Artificial Sequence
  siRNA Sense Sequence
guucgaggcuaugaucaca

SEQ ID NO: 4633 - RNA, 19 nt, Artificial Sequence
  siRNA Antisense Sequence
ugugaucauagccucgaac

SEQ ID NO: 4634 - RNA, 19 nt, Artificial Sequence
  siRNA Sense Sequence
uucgaggcuaugaucacac

SEQ ID NO: 4635 - RNA, 19 nt, Artificial Sequence
  siRNA Antisense Sequence
gugugaucauagccucgaa

SEQ ID NO: 4636 - RNA, 19 nt, Artificial Sequence
  siRNA Sense Sequence
ucgaggcuaugaucacacu

SEQ ID NO: 4637 - RNA, 19 nt, Artificial Sequence
  siRNA Antisense Sequence
agugugaucauagccucga

SEQ ID NO: 4638 - RNA, 19 nt, Artificial Sequence
  siRNA Sense Sequence
cgaggcuaugaucacacuu

SEQ ID NO: 4639 - RNA, 19 nt, Artificial Sequence
  siRNA Antisense Sequence
aagugugaucauagccucg

SEQ ID NO: 4640 - RNA, 19 nt, Artificial Sequence
  siRNA Sense Sequence
gaggcuaugaucacacuug

SEQ ID NO: 4641 - RNA, 19 nt, Artificial Sequence
  siRNA Antisense Sequence
caagugugaucauagccuc

SEQ ID NO: 4642 - RNA, 19 nt, Artificial Sequence
  siRNA Sense Sequence
ugcacuccagccugggcaa

SEQ ID NO: 4643 - RNA, 19 nt, Artificial Sequence
  siRNA Antisense Sequence
uugcccaggcuggagugca

SEQ ID NO: 4644 - RNA, 19 nt, Artificial Sequence
  siRNA Sense Sequence
gcacuccagccugggcaaa

SEQ ID NO: 4645 - RNA, 19 nt, Artificial Sequence
  siRNA Antisense Sequence
uuugcccaggcuggagugc

SEQ ID NO: 4646 - RNA, 19 nt, Artificial Sequence
  siRNA Sense Sequence
cacuccagccugggcaaau

SEQ ID NO: 4647 - RNA, 19 nt, Artificial Sequence
  siRNA Antisense Sequence
auuugcccaggcuggagug

SEQ ID NO: 4648 - RNA, 19 nt, Artificial Sequence
  siRNA Sense Sequence
acuccagccugggcaaaua

SEQ ID NO: 4649 - RNA, 19 nt, Artificial Sequence
  siRNA Antisense Sequence
uauuugcccaggcuggagu

SEQ ID NO: 4650 - RNA, 19 nt, Artificial Sequence
  siRNA Sense Sequence
uacauaaauagcuccucug

SEQ ID NO: 4651 - RNA, 19 nt, Artificial Sequence
  siRNA Antisense Sequence
cagaggagcuauuuaugua

SEQ ID NO: 4652 - RNA, 19 nt, Artificial Sequence
  siRNA Sense Sequence
acauaaauagcuccucugg

SEQ ID NO: 4653 - RNA, 19 nt, Artificial Sequence
  siRNA Antisense Sequence
ccagaggagcuauuuaugu

SEQ ID NO: 4654 - RNA, 19 nt, Artificial Sequence
  siRNA Sense Sequence
cauaaauagcuccucugga

SEQ ID NO: 4655 - RNA, 19 nt, Artificial Sequence
  siRNA Antisense Sequence
uccagaggagcuauuuaug

SEQ ID NO: 4656 - RNA, 19 nt, Artificial Sequence
  siRNA Sense Sequence
auaaauagcuccucuggaa

SEQ ID NO: 4657 - RNA, 19 nt, Artificial Sequence
  siRNA Antisense Sequence
uuccagaggagcuauuuau

SEQ ID NO: 4658 - RNA, 19 nt, Artificial Sequence
  siRNA Sense Sequence
aaauagcuccucuggaaga

SEQ ID NO: 4659 - RNA, 19 nt, Artificial Sequence
  siRNA Antisense Sequence
ucuuccagaggagcuauuu

SEQ ID NO: 4660 - RNA, 19 nt, Artificial Sequence
  siRNA Sense Sequence
aggcugggacaggagcaug

SEQ ID NO: 4661 - RNA, 19 nt, Artificial Sequence
  siRNA Antisense Sequence
caugcuccugucccagccu

SEQ ID NO: 4662 - RNA, 19 nt, Artificial Sequence
  siRNA Sense Sequence
ggcugggacaggagcaugu

SEQ ID NO: 4663 - RNA, 19 nt, Artificial Sequence
  siRNA Antisense Sequence
acaugcuccugucccagcc

SEQ ID NO: 4664 - RNA, 19 nt, Artificial Sequence
  siRNA Sense Sequence
gcugggacaggagcaugug

SEQ ID NO: 4665 - RNA, 19 nt, Artificial Sequence
  siRNA Antisense Sequence
cacaugcuccugucccagc

SEQ ID NO: 4666 - RNA, 19 nt, Artificial Sequence
  siRNA Sense Sequence
ugggacaggagcaugugug

SEQ ID NO: 4667 - RNA, 19 nt, Artificial Sequence
  siRNA Antisense Sequence
cacacaugcuccuguccca

SEQ ID NO: 4668 - RNA, 19 nt, Artificial Sequence
  siRNA Sense Sequence
gggacaggagcaugugugg

SEQ ID NO: 4669 - RNA, 19 nt, Artificial Sequence
  siRNA Antisense Sequence
ccacacaugcuccuguccc

SEQ ID NO: 4670 - RNA, 19 nt, Artificial Sequence
  siRNA Sense Sequence
ggacaggagcauguguggg

SEQ ID NO: 4671 - RNA, 19 nt, Artificial Sequence
  siRNA Antisense Sequence
cccacacaugcuccugucc

SEQ ID NO: 4672 - RNA, 19 nt, Artificial Sequence
  siRNA Sense Sequence
uuuucagugcccauuaguc

SEQ ID NO: 4673 - RNA, 19 nt, Artificial Sequence
  siRNA Antisense Sequence
gacuaaugggcacugaaaa

SEQ ID NO: 4674 - RNA, 19 nt, Artificial Sequence
  siRNA Sense Sequence
uuucagugcccauuagucu

SEQ ID NO: 4675 - RNA, 19 nt, Artificial Sequence
  siRNA Antisense Sequence
agacuaaugggcacugaaa

SEQ ID NO: 4676 - RNA, 19 nt, Artificial Sequence
  siRNA Sense Sequence
uucagugcccauuagucug

SEQ ID NO: 4677 - RNA, 19 nt, Artificial Sequence
  siRNA Antisense Sequence
cagacuaaugggcacugaa

SEQ ID NO: 4678 - RNA, 19 nt, Artificial Sequence
  siRNA Sense Sequence
cagugcccauuagucuggu

SEQ ID NO: 4679 - RNA, 19 nt, Artificial Sequence
  siRNA Antisense Sequence
accagacuaaugggcacug

SEQ ID NO: 4680 - RNA, 19 nt, Artificial Sequence
  siRNA Sense Sequence
agugcccauuagucugguc

SEQ ID NO: 4681 - RNA, 19 nt, Artificial Sequence
  siRNA Antisense Sequence
gaccagacuaaugggcacu

SEQ ID NO: 4682 - RNA, 19 nt, Artificial Sequence
  siRNA Sense Sequence
gugcccauuagucuggucu

SEQ ID NO: 4683 - RNA, 19 nt, Artificial Sequence
  siRNA Antisense Sequence
agaccagacuaaugggcac

SEQ ID NO: 4684 - RNA, 19 nt, Artificial Sequence
  siRNA Sense Sequence
ugcccauuagucuggucug

SEQ ID NO: 4685 - RNA, 19 nt, Artificial Sequence
  siRNA Antisense Sequence
cagaccagacuaaugggca

SEQ ID NO: 4686 - RNA, 19 nt, Artificial Sequence
  siRNA Sense Sequence
gcccauuagucuggucuga

SEQ ID NO: 4687 - RNA, 19 nt, Artificial Sequence
  siRNA Antisense Sequence
ucagaccagacuaaugggc

SEQ ID NO: 4688 - RNA, 19 nt, Artificial Sequence
  siRNA Sense Sequence
gucuggucugacugagcug

SEQ ID NO: 4689 - RNA, 19 nt, Artificial Sequence
  siRNA Antisense Sequence
cagcucagucagaccagac

SEQ ID NO: 4690 - RNA, 19 nt, Artificial Sequence
  siRNA Sense Sequence
ucuggucugacugagcugg

SEQ ID NO: 4691 - RNA, 19 nt, Artificial Sequence
  siRNA Antisense Sequence
ccagcucagucagaccaga

SEQ ID NO: 4692 - RNA, 19 nt, Artificial Sequence
  siRNA Sense Sequence
cuggucugacugagcuggg

SEQ ID NO: 4693 - RNA, 19 nt, Artificial Sequence
  siRNA Antisense Sequence
cccagcucagucagaccag

SEQ ID NO: 4694 - RNA, 19 nt, Artificial Sequence
  siRNA Sense Sequence
uggucugacugagcugggu

SEQ ID NO: 4695 - RNA, 19 nt, Artificial Sequence
  siRNA Antisense Sequence
acccagcucagucagacca

SEQ ID NO: 4696 - RNA, 19 nt, Artificial Sequence
  siRNA Sense Sequence
ggucugacugagcuggguc

SEQ ID NO: 4697 - RNA, 19 nt, Artificial Sequence
  siRNA Antisense Sequence
gacccagcucagucagacc

SEQ ID NO: 4698 - RNA, 19 nt, Artificial Sequence
  siRNA Sense Sequence
gucugacugagcugggucu

SEQ ID NO: 4699 - RNA, 19 nt, Artificial Sequence
  siRNA Antisense Sequence
agacccagcucagucagac

SEQ ID NO: 4700 - RNA, 19 nt, Artificial Sequence
  siRNA Sense Sequence
ucugacugagcugggucuc

SEQ ID NO: 4701 - RNA, 19 nt, Artificial Sequence
  siRNA Antisense Sequence
gagacccagcucagucaga

SEQ ID NO: 4702 - RNA, 19 nt, Artificial Sequence
  siRNA Sense Sequence
cugacugagcugggucucu

SEQ ID NO: 4703 - RNA, 19 nt, Artificial Sequence
  siRNA Antisense Sequence
agagacccagcucagucag

SEQ ID NO: 4704 - RNA, 19 nt, Artificial Sequence
  siRNA Sense Sequence
ugacugagcugggucucug

SEQ ID NO: 4705 - RNA, 19 nt, Artificial Sequence
  siRNA Antisense Sequence
cagagacccagcucaguca

SEQ ID NO: 4706 - RNA, 19 nt, Artificial Sequence
  siRNA Sense Sequence
gacugagcugggucucuga

SEQ ID NO: 4707 - RNA, 19 nt, Artificial Sequence
  siRNA Antisense Sequence
ucagagacccagcucaguc

SEQ ID NO: 4708 - RNA, 19 nt, Artificial Sequence
  siRNA Sense Sequence
acugagcugggucucugac

SEQ ID NO: 4709 - RNA, 19 nt, Artificial Sequence
  siRNA Antisense Sequence
gucagagacccagcucagu

SEQ ID NO: 4710 - RNA, 19 nt, Artificial Sequence
  siRNA Sense Sequence
gggauaacuagccuggguc

SEQ ID NO: 4711 - RNA, 19 nt, Artificial Sequence
  siRNA Antisense Sequence
gacccaggcuaguuauccc

SEQ ID NO: 4712 - RNA, 19 nt, Artificial Sequence
  siRNA Sense Sequence
ggauaacuagccuggguca

SEQ ID NO: 4713 - RNA, 19 nt, Artificial Sequence
  siRNA Antisense Sequence
ugacccaggcuaguuaucc

SEQ ID NO: 4714 - RNA, 19 nt, Artificial Sequence
  siRNA Sense Sequence
gauaacuagccugggucaa

SEQ ID NO: 4715 - RNA, 19 nt, Artificial Sequence
  siRNA Antisense Sequence
uugacccaggcuaguuauc

SEQ ID NO: 4716 - RNA, 19 nt, Artificial Sequence
  siRNA Sense Sequence
auaacuagccugggucaaa

SEQ ID NO: 4717 - RNA, 19 nt, Artificial Sequence
  siRNA Antisense Sequence
uuugacccaggcuaguuau

SEQ ID NO: 4718 - RNA, 19 nt, Artificial Sequence
  siRNA Sense Sequence
uaacuagccugggucaaag

SEQ ID NO: 4719 - RNA, 19 nt, Artificial Sequence
  siRNA Antisense Sequence
cuuugacccaggcuaguua

SEQ ID NO: 4720 - RNA, 19 nt, Artificial Sequence
  siRNA Sense Sequence
aacuagccugggucaaagu

SEQ ID NO: 4721 - RNA, 19 nt, Artificial Sequence
  siRNA Antisense Sequence
acuuugacccaggcuaguu

SEQ ID NO: 4722 - RNA, 19 nt, Artificial Sequence
  siRNA Sense Sequence
acuagccugggucaaaguc

SEQ ID NO: 4723 - RNA, 19 nt, Artificial Sequence
  siRNA Antisense Sequence
gacuuugacccaggcuagu

SEQ ID NO: 4724 - RNA, 19 nt, Artificial Sequence
  siRNA Sense Sequence
cuagccugggucaaagucc

SEQ ID NO: 4725 - RNA, 19 nt, Artificial Sequence
  siRNA Antisense Sequence
ggacuuugacccaggcuag

SEQ ID NO: 4726 - RNA, 19 nt, Artificial Sequence
  siRNA Sense Sequence
uagccugggucaaaguccc

SEQ ID NO: 4727 - RNA, 19 nt, Artificial Sequence
  siRNA Antisense Sequence
gggacuuugacccaggcua

SEQ ID NO: 4728 - RNA, 19 nt, Artificial Sequence
  siRNA Sense Sequence
ggucaaagucccagaucuc

SEQ ID NO: 4729 - RNA, 19 nt, Artificial Sequence
  siRNA Antisense Sequence
gagaucugggacuuugacc

SEQ ID NO: 4730 - RNA, 19 nt, Artificial Sequence
  siRNA Sense Sequence
gucaaagucccagaucucc

SEQ ID NO: 4731 - RNA, 19 nt, Artificial Sequence
  siRNA Antisense Sequence
ggagaucugggacuuugac

SEQ ID NO: 4732 - RNA, 19 nt, Artificial Sequence
  siRNA Sense Sequence
ucaaagucccagaucuccc

SEQ ID NO: 4733 - RNA, 19 nt, Artificial Sequence
  siRNA Antisense Sequence
gggagaucugggacuuuga

SEQ ID NO: 4734 - RNA, 19 nt, Artificial Sequence
  siRNA Sense Sequence
ccuaccuucaccuuuucuu

SEQ ID NO: 4735 - RNA, 19 nt, Artificial Sequence
  siRNA Antisense Sequence
aagaaaaggugaagguagg

SEQ ID NO: 4736 - RNA, 19 nt, Artificial Sequence
  siRNA Sense Sequence
ccuucaccuuuucuuuucc

SEQ ID NO: 4737 - RNA, 19 nt, Artificial Sequence
  siRNA Antisense Sequence
ggaaaagaaaaggugaagg

SEQ ID NO: 4738 - RNA, 19 nt, Artificial Sequence
  siRNA Sense Sequence
aacccacugaccuuccaca

SEQ ID NO: 4739 - RNA, 19 nt, Artificial Sequence
  siRNA Antisense Sequence
uguggaaggucaguggguu

SEQ ID NO: 4740 - RNA, 19 nt, Artificial Sequence
  siRNA Sense Sequence
acccacugaccuuccacac

SEQ ID NO: 4741 - RNA, 19 nt, Artificial Sequence
  siRNA Antisense Sequence
guguggaaggucagugggu

SEQ ID NO: 4742 - RNA, 19 nt, Artificial Sequence
  siRNA Sense Sequence
acugaccuuccacacccaa

SEQ ID NO: 4743 - RNA, 19 nt, Artificial Sequence
  siRNA Antisense Sequence
uuggguguggaaggucagu

SEQ ID NO: 4744 - RNA, 19 nt, Artificial Sequence
  siRNA Sense Sequence
cugaccuuccacacccaag

SEQ ID NO: 4745 - RNA, 19 nt, Artificial Sequence
  siRNA Antisense Sequence
cuuggguguggaaggucag

SEQ ID NO: 4746 - RNA, 19 nt, Artificial Sequence
  siRNA Sense Sequence
gggugguucuuggaagcag

SEQ ID NO: 4747 - RNA, 19 nt, Artificial Sequence
  siRNA Antisense Sequence
cugcuuccaagaaccaccc

SEQ ID NO: 4748 - RNA, 19 nt, Artificial Sequence
  siRNA Sense Sequence
ggugguucuuggaagcaga

SEQ ID NO: 4749 - RNA, 19 nt, Artificial Sequence
  siRNA Antisense Sequence
ucugcuuccaagaaccacc

SEQ ID NO: 4750 - RNA, 19 nt, Artificial Sequence
  siRNA Sense Sequence
gugguucuuggaagcagag

SEQ ID NO: 4751 - RNA, 19 nt, Artificial Sequence
  siRNA Antisense Sequence
cucugcuuccaagaaccac

SEQ ID NO: 4752 - RNA, 19 nt, Artificial Sequence
  siRNA Sense Sequence
ugguucuuggaagcagagc

SEQ ID NO: 4753 - RNA, 19 nt, Artificial Sequence
  siRNA Antisense Sequence
gcucugcuuccaagaacca

SEQ ID NO: 4754 - RNA, 19 nt, Artificial Sequence
  siRNA Sense Sequence
gguucuuggaagcagagcu

SEQ ID NO: 4755 - RNA, 19 nt, Artificial Sequence
  siRNA Antisense Sequence
agcucugcuuccaagaacc

SEQ ID NO: 4756 - RNA, 19 nt, Artificial Sequence
  siRNA Sense Sequence
guucuuggaagcagagcua

SEQ ID NO: 4757 - RNA, 19 nt, Artificial Sequence
  siRNA Antisense Sequence
uagcucugcuuccaagaac

SEQ ID NO: 4758 - RNA, 19 nt, Artificial Sequence
  siRNA Sense Sequence
uucuuggaagcagagcuag

SEQ ID NO: 4759 - RNA, 19 nt, Artificial Sequence
  siRNA Antisense Sequence
cuagcucugcuuccaagaa

SEQ ID NO: 4760 - RNA, 19 nt, Artificial Sequence
  siRNA Sense Sequence
cuuggaagcagagcuagga

SEQ ID NO: 4761 - RNA, 19 nt, Artificial Sequence
  siRNA Antisense Sequence
uccuagcucugcuuccaag

SEQ ID NO: 4762 - RNA, 19 nt, Artificial Sequence
  siRNA Sense Sequence
uggaagcagagcuaggaug

SEQ ID NO: 4763 - RNA, 19 nt, Artificial Sequence
  siRNA Antisense Sequence
cauccuagcucugcuucca

SEQ ID NO: 4764 - RNA, 19 nt, Artificial Sequence
  siRNA Sense Sequence
ggaagcagagcuaggaugu

SEQ ID NO: 4765 - RNA, 19 nt, Artificial Sequence
  siRNA Antisense Sequence
acauccuagcucugcuucc

SEQ ID NO: 4766 - RNA, 19 nt, Artificial Sequence
  siRNA Sense Sequence
agcuaggaugugggagguc

SEQ ID NO: 4767 - RNA, 19 nt, Artificial Sequence
  siRNA Antisense Sequence
gaccucccacauccuagcu

SEQ ID NO: 4768 - RNA, 19 nt, Artificial Sequence
  siRNA Sense Sequence
gcuaggaugugggaggucu

SEQ ID NO: 4769 - RNA, 19 nt, Artificial Sequence
  siRNA Antisense Sequence
agaccucccacauccuagc

SEQ ID NO: 4770 - RNA, 19 nt, Artificial Sequence
  siRNA Sense Sequence
cuaggaugugggaggucug

SEQ ID NO: 4771 - RNA, 19 nt, Artificial Sequence
  siRNA Antisense Sequence
cagaccucccacauccuag

SEQ ID NO: 4772 - RNA, 19 nt, Artificial Sequence
  siRNA Sense Sequence
uaggaugugggaggucugc

SEQ ID NO: 4773 - RNA, 19 nt, Artificial Sequence
  siRNA Antisense Sequence
gcagaccucccacauccua

SEQ ID NO: 4774 - RNA, 19 nt, Artificial Sequence
  siRNA Sense Sequence
aggaugugggaggucugcc

SEQ ID NO: 4775 - RNA, 19 nt, Artificial Sequence
  siRNA Antisense Sequence
ggcagaccucccacauccu

SEQ ID NO: 4776 - RNA, 19 nt, Artificial Sequence
  siRNA Sense Sequence
ggaugugggaggucugccu

SEQ ID NO: 4777 - RNA, 19 nt, Artificial Sequence
  siRNA Antisense Sequence
aggcagaccucccacaucc

SEQ ID NO: 4778 - RNA, 19 nt, Artificial Sequence
  siRNA Sense Sequence
gaugugggaggucugccug

SEQ ID NO: 4779 - RNA, 19 nt, Artificial Sequence
  siRNA Antisense Sequence
caggcagaccucccacauc

SEQ ID NO: 4780 - RNA, 19 nt, Artificial Sequence
  siRNA Sense Sequence
augugggaggucugccugu

SEQ ID NO: 4781 - RNA, 19 nt, Artificial Sequence
  siRNA Antisense Sequence
acaggcagaccucccacau

SEQ ID NO: 4782 - RNA, 19 nt, Artificial Sequence
  siRNA Sense Sequence
uuuccuugucaugcuuccu

SEQ ID NO: 4783 - RNA, 19 nt, Artificial Sequence
  siRNA Antisense Sequence
aggaagcaugacaaggaaa

SEQ ID NO: 4784 - RNA, 19 nt, Artificial Sequence
  siRNA Sense Sequence
uuccuugucaugcuuccuc

SEQ ID NO: 4785 - RNA, 19 nt, Artificial Sequence
  siRNA Antisense Sequence
gaggaagcaugacaaggaa

SEQ ID NO: 4786 - RNA, 19 nt, Artificial Sequence
  siRNA Sense Sequence
ugucaugcuuccuccucuu

SEQ ID NO: 4787 - RNA, 19 nt, Artificial Sequence
  siRNA Antisense Sequence
aagaggaggaagcaugaca

SEQ ID NO: 4788 - RNA, 19 nt, Artificial Sequence
  siRNA Sense Sequence
ucaugcuuccuccucuuuc

SEQ ID NO: 4789 - RNA, 19 nt, Artificial Sequence
  siRNA Antisense Sequence
gaaagaggaggaagcauga

SEQ ID NO: 4790 - RNA, 19 nt, Artificial Sequence
  siRNA Sense Sequence
cuuccuccucuuucucaua

SEQ ID NO: 4791 - RNA, 19 nt, Artificial Sequence
  siRNA Antisense Sequence
uaugagaaagaggaggaag

SEQ ID NO: 4792 - RNA, 19 nt, Artificial Sequence
  siRNA Sense Sequence
uccuccucuuucucauaaa

SEQ ID NO: 4793 - RNA, 19 nt, Artificial Sequence
  siRNA Antisense Sequence
uuuaugagaaagaggagga

SEQ ID NO: 4794 - RNA, 19 nt, Artificial Sequence
  siRNA Sense Sequence
ccuccucuuucucauaaaa

SEQ ID NO: 4795 - RNA, 19 nt, Artificial Sequence
  siRNA Antisense Sequence
uuuuaugagaaagaggagg

SEQ ID NO: 4796 - RNA, 19 nt, Artificial Sequence
  siRNA Sense Sequence
ucacgauggcaaugcaaau

SEQ ID NO: 4797 - RNA, 19 nt, Artificial Sequence
  siRNA Antisense Sequence
auuugcauugccaucguga

SEQ ID NO: 4798 - RNA, 19 nt, Artificial Sequence
  siRNA Sense Sequence
cacgauggcaaugcaaauc

SEQ ID NO: 4799 - RNA, 19 nt, Artificial Sequence
  siRNA Antisense Sequence
gauuugcauugccaucgug

SEQ ID NO: 4800 - RNA, 19 nt, Artificial Sequence
  siRNA Sense Sequence
acgauggcaaugcaaaucu

SEQ ID NO: 4801 - RNA, 19 nt, Artificial Sequence
  siRNA Antisense Sequence
agauuugcauugccaucgu

SEQ ID NO: 4802 - RNA, 19 nt, Artificial Sequence
  siRNA Sense Sequence
cgauggcaaugcaaaucua

SEQ ID NO: 4803 - RNA, 19 nt, Artificial Sequence
  siRNA Antisense Sequence
uagauuugcauugccaucg

SEQ ID NO: 4804 - RNA, 19 nt, Artificial Sequence
  siRNA Sense Sequence
gauggcaaugcaaaucuaa

SEQ ID NO: 4805 - RNA, 19 nt, Artificial Sequence
  siRNA Antisense Sequence
uuagauuugcauugccauc

SEQ ID NO: 4806 - RNA, 19 nt, Artificial Sequence
  siRNA Sense Sequence
uggcaaugcaaaucuaaag

SEQ ID NO: 4807 - RNA, 19 nt, Artificial Sequence
  siRNA Antisense Sequence
cuuuagauuugcauugcca

SEQ ID NO: 4808 - RNA, 19 nt, Artificial Sequence
  siRNA Sense Sequence
ggcaaugcaaaucuaaaga

SEQ ID NO: 4809 - RNA, 19 nt, Artificial Sequence
  siRNA Antisense Sequence
ucuuuagauuugcauugcc

SEQ ID NO: 4810 - RNA, 19 nt, Artificial Sequence
  siRNA Sense Sequence
augcaaaucuaaagaggca

SEQ ID NO: 4811 - RNA, 19 nt, Artificial Sequence
  siRNA Antisense Sequence
ugccucuuuagauuugcau

SEQ ID NO: 4812 - RNA, 19 nt, Artificial Sequence
  siRNA Sense Sequence
gcaaaucuaaagaggcagg

SEQ ID NO: 4813 - RNA, 19 nt, Artificial Sequence
  siRNA Antisense Sequence
ccugccucuuuagauuugc

SEQ ID NO: 4814 - RNA, 19 nt, Artificial Sequence
  siRNA Sense Sequence
caaaucuaaagaggcaggg

SEQ ID NO: 4815 - RNA, 19 nt, Artificial Sequence
  siRNA Antisense Sequence
cccugccucuuuagauuug

SEQ ID NO: 4816 - RNA, 19 nt, Artificial Sequence
  siRNA Sense Sequence
aaaucuaaagaggcagggc

SEQ ID NO: 4817 - RNA, 19 nt, Artificial Sequence
  siRNA Antisense Sequence
gcccugccucuuuagauuu

SEQ ID NO: 4818 - RNA, 19 nt, Artificial Sequence
  siRNA Sense Sequence
acuucccugucaggcagua

SEQ ID NO: 4819 - RNA, 19 nt, Artificial Sequence
  siRNA Antisense Sequence
uacugccugacagggaagu

SEQ ID NO: 4820 - RNA, 19 nt, Artificial Sequence
  siRNA Sense Sequence
cuucccugucaggcaguac

SEQ ID NO: 4821 - RNA, 19 nt, Artificial Sequence
  siRNA Antisense Sequence
guacugccugacagggaag

SEQ ID NO: 4822 - RNA, 19 nt, Artificial Sequence
  siRNA Sense Sequence
uucccugucaggcaguacc

SEQ ID NO: 4823 - RNA, 19 nt, Artificial Sequence
  siRNA Antisense Sequence
gguacugccugacagggaa

SEQ ID NO: 4824 - RNA, 19 nt, Artificial Sequence
  siRNA Sense Sequence
ucccugucaggcaguaccg

SEQ ID NO: 4825 - RNA, 19 nt, Artificial Sequence
  siRNA Antisense Sequence
cgguacugccugacaggga

SEQ ID NO: 4826 - RNA, 19 nt, Artificial Sequence
  siRNA Sense Sequence
ccugucaggcaguaccgcu

SEQ ID NO: 4827 - RNA, 19 nt, Artificial Sequence
  siRNA Antisense Sequence
agcgguacugccugacagg

SEQ ID NO: 4828 - RNA, 19 nt, Artificial Sequence
  siRNA Sense Sequence
cugucaggcaguaccgcug

SEQ ID NO: 4829 - RNA, 19 nt, Artificial Sequence
  siRNA Antisense Sequence
cagcgguacugccugacag

SEQ ID NO: 4830 - RNA, 19 nt, Artificial Sequence
  siRNA Sense Sequence
ugucaggcaguaccgcugg

SEQ ID NO: 4831 - RNA, 19 nt, Artificial Sequence
  siRNA Antisense Sequence
ccagcgguacugccugaca

SEQ ID NO: 4832 - RNA, 19 nt, Artificial Sequence
  siRNA Sense Sequence
aggcaguaccgcugggcau

SEQ ID NO: 4833 - RNA, 19 nt, Artificial Sequence
  siRNA Antisense Sequence
augcccagcgguacugccu

SEQ ID NO: 4834 - RNA, 19 nt, Artificial Sequence
  siRNA Sense Sequence
ggcaguaccgcugggcaua

SEQ ID NO: 4835 - RNA, 19 nt, Artificial Sequence
  siRNA Antisense Sequence
uaugcccagcgguacugcc

SEQ ID NO: 4836 - RNA, 19 nt, Artificial Sequence
  siRNA Sense Sequence
gcaguaccgcugggcauag

SEQ ID NO: 4837 - RNA, 19 nt, Artificial Sequence
  siRNA Antisense Sequence
cuaugcccagcgguacugc

SEQ ID NO: 4838 - RNA, 19 nt, Artificial Sequence
  siRNA Sense Sequence
uaccgcugggcauagcaac

SEQ ID NO: 4839 - RNA, 19 nt, Artificial Sequence
  siRNA Antisense Sequence
guugcuaugcccagcggua

SEQ ID NO: 4840 - RNA, 19 nt, Artificial Sequence
  siRNA Sense Sequence
accgcugggcauagcaacc

SEQ ID NO: 4841 - RNA, 19 nt, Artificial Sequence
  siRNA Antisense Sequence
gguugcuaugcccagcggu

SEQ ID NO: 4842 - RNA, 19 nt, Artificial Sequence
  siRNA Sense Sequence
ccgcugggcauagcaaccu

SEQ ID NO: 4843 - RNA, 19 nt, Artificial Sequence
  siRNA Antisense Sequence
agguugcuaugcccagcgg

SEQ ID NO: 4844 - RNA, 19 nt, Artificial Sequence
  siRNA Sense Sequence
ccucugccucuccguuucu

SEQ ID NO: 4845 - RNA, 19 nt, Artificial Sequence
  siRNA Antisense Sequence
agaaacggagaggcagagg

SEQ ID NO: 4846 - RNA, 19 nt, Artificial Sequence
  siRNA Sense Sequence
ugccucuccguuucucaga

SEQ ID NO: 4847 - RNA, 19 nt, Artificial Sequence
  siRNA Antisense Sequence
ucugagaaacggagaggca

SEQ ID NO: 4848 - RNA, 19 nt, Artificial Sequence
  siRNA Sense Sequence
ucuccguuucucagagcuc

SEQ ID NO: 4849 - RNA, 19 nt, Artificial Sequence
  siRNA Antisense Sequence
gagcucugagaaacggaga

SEQ ID NO: 4850 - RNA, 19 nt, Artificial Sequence
  siRNA Sense Sequence
cuccguuucucagagcuca

SEQ ID NO: 4851 - RNA, 19 nt, Artificial Sequence
  siRNA Antisense Sequence
ugagcucugagaaacggag

SEQ ID NO: 4852 - RNA, 19 nt, Artificial Sequence
  siRNA Sense Sequence
uccguuucucagagcucac

SEQ ID NO: 4853 - RNA, 19 nt, Artificial Sequence
  siRNA Antisense Sequence
gugagcucugagaaacgga

SEQ ID NO: 4854 - RNA, 19 nt, Artificial Sequence
  siRNA Sense Sequence
ccguuucucagagcucaca

SEQ ID NO: 4855 - RNA, 19 nt, Artificial Sequence
  siRNA Antisense Sequence
ugugagcucugagaaacgg

SEQ ID NO: 4856 - RNA, 19 nt, Artificial Sequence
  siRNA Sense Sequence
cguuucucagagcucacau

SEQ ID NO: 4857 - RNA, 19 nt, Artificial Sequence
  siRNA Antisense Sequence
augugagcucugagaaacg

SEQ ID NO: 4858 - RNA, 19 nt, Artificial Sequence
  siRNA Sense Sequence
uuucucagagcucacauau

SEQ ID NO: 4859 - RNA, 19 nt, Artificial Sequence
  siRNA Antisense Sequence
auaugugagcucugagaaa

SEQ ID NO: 4860 - RNA, 19 nt, Artificial Sequence
  siRNA Sense Sequence
agagcucacauauccaccu

SEQ ID NO: 4861 - RNA, 19 nt, Artificial Sequence
  siRNA Antisense Sequence
agguggauaugugagcucu

SEQ ID NO: 4862 - RNA, 19 nt, Artificial Sequence
  siRNA Sense Sequence
gagcucacauauccaccuc

SEQ ID NO: 4863 - RNA, 19 nt, Artificial Sequence
  siRNA Antisense Sequence
gagguggauaugugagcuc

SEQ ID NO: 4864 - RNA, 19 nt, Artificial Sequence
  siRNA Sense Sequence
agcucacauauccaccucc

SEQ ID NO: 4865 - RNA, 19 nt, Artificial Sequence
  siRNA Antisense Sequence
ggagguggauaugugagcu

SEQ ID NO: 4866 - RNA, 19 nt, Artificial Sequence
  siRNA Sense Sequence
cauauccaccuccugggcu

SEQ ID NO: 4867 - RNA, 19 nt, Artificial Sequence
  siRNA Antisense Sequence
agcccaggagguggauaug

SEQ ID NO: 4868 - RNA, 19 nt, Artificial Sequence
  siRNA Sense Sequence
auauccaccuccugggcuu

SEQ ID NO: 4869 - RNA, 19 nt, Artificial Sequence
  siRNA Antisense Sequence
aagcccaggagguggauau

SEQ ID NO: 4870 - RNA, 19 nt, Artificial Sequence
  siRNA Sense Sequence
uauccaccuccugggcuuu

SEQ ID NO: 4871 - RNA, 19 nt, Artificial Sequence
  siRNA Antisense Sequence
aaagcccaggagguggaua

SEQ ID NO: 4872 - RNA, 19 nt, Artificial Sequence
  siRNA Sense Sequence
auccaccuccugggcuuuu

SEQ ID NO: 4873 - RNA, 19 nt, Artificial Sequence
  siRNA Antisense Sequence
aaaagcccaggagguggau

SEQ ID NO: 4874 - RNA, 19 nt, Artificial Sequence
  siRNA Sense Sequence
uccaccuccugggcuuuua

SEQ ID NO: 4875 - RNA, 19 nt, Artificial Sequence
  siRNA Antisense Sequence
uaaaagcccaggaggugga

SEQ ID NO: 4876 - RNA, 19 nt, Artificial Sequence
  siRNA Sense Sequence
ccaccuccugggcuuuuaa

SEQ ID NO: 4877 - RNA, 19 nt, Artificial Sequence
  siRNA Antisense Sequence
uuaaaagcccaggaggugg

SEQ ID NO: 4878 - RNA, 19 nt, Artificial Sequence
  siRNA Sense Sequence
uccugggcuuuuaaguggg

SEQ ID NO: 4879 - RNA, 19 nt, Artificial Sequence
  siRNA Antisense Sequence
cccacuuaaaagcccagga

SEQ ID NO: 4880 - RNA, 19 nt, Artificial Sequence
  siRNA Sense Sequence
ccugggcuuuuaagugggc

SEQ ID NO: 4881 - RNA, 19 nt, Artificial Sequence
  siRNA Antisense Sequence
gcccacuuaaaagcccagg

SEQ ID NO: 4882 - RNA, 19 nt, Artificial Sequence
  siRNA Sense Sequence
cugggcuuuuaagugggcu

SEQ ID NO: 4883 - RNA, 19 nt, Artificial Sequence
  siRNA Antisense Sequence
agcccacuuaaaagcccag

SEQ ID NO: 4884 - RNA, 19 nt, Artificial Sequence
  siRNA Sense Sequence
ugggcuuuuaagugggcuu

SEQ ID NO: 4885 - RNA, 19 nt, Artificial Sequence
  siRNA Antisense Sequence
aagcccacuuaaaagccca

SEQ ID NO: 4886 - RNA, 19 nt, Artificial Sequence
  siRNA Sense Sequence
gggcuuuuaagugggcuuu

SEQ ID NO: 4887 - RNA, 19 nt, Artificial Sequence
  siRNA Antisense Sequence
aaagcccacuuaaaagccc

SEQ ID NO: 4888 - RNA, 19 nt, Artificial Sequence
  siRNA Sense Sequence
uuuuaagugggcuuuagug

SEQ ID NO: 4889 - RNA, 19 nt, Artificial Sequence
  siRNA Antisense Sequence
cacuaaagcccacuuaaaa

SEQ ID NO: 4890 - RNA, 19 nt, Artificial Sequence
  siRNA Sense Sequence
uuuaagugggcuuuaguga

SEQ ID NO: 4891 - RNA, 19 nt, Artificial Sequence
  siRNA Antisense Sequence
ucacuaaagcccacuuaaa

SEQ ID NO: 4892 - RNA, 19 nt, Artificial Sequence
  siRNA Sense Sequence
uuaagugggcuuuagugag

SEQ ID NO: 4893 - RNA, 19 nt, Artificial Sequence
  siRNA Antisense Sequence
cucacuaaagcccacuuaa

SEQ ID NO: 4894 - RNA, 19 nt, Artificial Sequence
  siRNA Sense Sequence
uaagugggcuuuagugagg

SEQ ID NO: 4895 - RNA, 19 nt, Artificial Sequence
  siRNA Antisense Sequence
ccucacuaaagcccacuua

SEQ ID NO: 4896 - RNA, 19 nt, Artificial Sequence
  siRNA Sense Sequence
aagugggcuuuagugaggg

SEQ ID NO: 4897 - RNA, 19 nt, Artificial Sequence
  siRNA Antisense Sequence
cccucacuaaagcccacuu

SEQ ID NO: 4898 - RNA, 19 nt, Artificial Sequence
  siRNA Sense Sequence
gggcuccuccuucaacugg

SEQ ID NO: 4899 - RNA, 19 nt, Artificial Sequence
  siRNA Antisense Sequence
ccaguugaaggaggagccc

SEQ ID NO: 4900 - RNA, 19 nt, Artificial Sequence
  siRNA Sense Sequence
ggcuccuccuucaacuggg

SEQ ID NO: 4901 - RNA, 19 nt, Artificial Sequence
  siRNA Antisense Sequence
cccaguugaaggaggagcc

SEQ ID NO: 4902 - RNA, 19 nt, Artificial Sequence
  siRNA Sense Sequence
gcuccuccuucaacugggc

SEQ ID NO: 4903 - RNA, 19 nt, Artificial Sequence
  siRNA Antisense Sequence
gcccaguugaaggaggagc

SEQ ID NO: 4904 - RNA, 19 nt, Artificial Sequence
  siRNA Sense Sequence
caacugggcuccuccuuca

SEQ ID NO: 4905 - RNA, 19 nt, Artificial Sequence
  siRNA Antisense Sequence
ugaaggaggagcccaguug

SEQ ID NO: 4906 - RNA, 19 nt, Artificial Sequence
  siRNA Sense Sequence
aacugggcuccuccuucag

SEQ ID NO: 4907 - RNA, 19 nt, Artificial Sequence
  siRNA Antisense Sequence
cugaaggaggagcccaguu

SEQ ID NO: 4908 - RNA, 19 nt, Artificial Sequence
  siRNA Sense Sequence
ugggcuccuccuucaguuc

SEQ ID NO: 4909 - RNA, 19 nt, Artificial Sequence
  siRNA Antisense Sequence
gaacugaaggaggagccca

SEQ ID NO: 4910 - RNA, 19 nt, Artificial Sequence
  siRNA Sense Sequence
gggcuccuccuucaguucc

SEQ ID NO: 4911 - RNA, 19 nt, Artificial Sequence
  siRNA Antisense Sequence
ggaacugaaggaggagccc

SEQ ID NO: 4912 - RNA, 19 nt, Artificial Sequence
  siRNA Sense Sequence
cccagcucuucugcuucga

SEQ ID NO: 4913 - RNA, 19 nt, Artificial Sequence
  siRNA Antisense Sequence
ucgaagcagaagagcuggg

SEQ ID NO: 4914 - RNA, 19 nt, Artificial Sequence
  siRNA Sense Sequence
ccagcucuucugcuucgac

SEQ ID NO: 4915 - RNA, 19 nt, Artificial Sequence
  siRNA Antisense Sequence
gucgaagcagaagagcugg

SEQ ID NO: 4916 - RNA, 19 nt, Artificial Sequence
  siRNA Sense Sequence
cagcucuucugcuucgacu

SEQ ID NO: 4917 - RNA, 19 nt, Artificial Sequence
  siRNA Antisense Sequence
agucgaagcagaagagcug

SEQ ID NO: 4918 - RNA, 19 nt, Artificial Sequence
  siRNA Sense Sequence
agcucuucugcuucgacuc

SEQ ID NO: 4919 - RNA, 19 nt, Artificial Sequence
  siRNA Antisense Sequence
gagucgaagcagaagagcu

SEQ ID NO: 4920 - RNA, 19 nt, Artificial Sequence
  siRNA Sense Sequence
gcucuucugcuucgacucc

SEQ ID NO: 4921 - RNA, 19 nt, Artificial Sequence
  siRNA Antisense Sequence
ggagucgaagcagaagagc

SEQ ID NO: 4922 - RNA, 19 nt, Artificial Sequence
  siRNA Sense Sequence
cucuucugcuucgacuccg

SEQ ID NO: 4923 - RNA, 19 nt, Artificial Sequence
  siRNA Antisense Sequence
cggagucgaagcagaagag

SEQ ID NO: 4924 - RNA, 19 nt, Artificial Sequence
  siRNA Sense Sequence
ucuucugcuucgacuccga

SEQ ID NO: 4925 - RNA, 19 nt, Artificial Sequence
  siRNA Antisense Sequence
ucggagucgaagcagaaga

SEQ ID NO: 4926 - RNA, 19 nt, Artificial Sequence
  siRNA Sense Sequence
cuucugcuucgacuccgag

SEQ ID NO: 4927 - RNA, 19 nt, Artificial Sequence
  siRNA Antisense Sequence
cucggagucgaagcagaag

SEQ ID NO: 4928 - RNA, 19 nt, Artificial Sequence
  siRNA Sense Sequence
uucgacuccgagcgggugu

SEQ ID NO: 4929 - RNA, 19 nt, Artificial Sequence
  siRNA Antisense Sequence
acacccgcucggagucgaa

SEQ ID NO: 4930 - RNA, 19 nt, Artificial Sequence
  siRNA Sense Sequence
uccgagcgggugucaugug

SEQ ID NO: 4931 - RNA, 19 nt, Artificial Sequence
  siRNA Antisense Sequence
cacaugacacccgcucgga

SEQ ID NO: 4932 - RNA, 19 nt, Artificial Sequence
  siRNA Sense Sequence
ccgagcgggugucaugugu

SEQ ID NO: 4933 - RNA, 19 nt, Artificial Sequence
  siRNA Antisense Sequence
acacaugacacccgcucgg

SEQ ID NO: 4934 - RNA, 19 nt, Artificial Sequence
  siRNA Sense Sequence
cgagcgggugucaugugug

SEQ ID NO: 4935 - RNA, 19 nt, Artificial Sequence
  siRNA Antisense Sequence
cacacaugacacccgcucg

SEQ ID NO: 4936 - RNA, 19 nt, Artificial Sequence
  siRNA Sense Sequence
gagcgggugucauguguga

SEQ ID NO: 4937 - RNA, 19 nt, Artificial Sequence
  siRNA Antisense Sequence
ucacacaugacacccgcuc

What is claimed is:

1. A method of treating a subject with a therapeutic agent that treats or inhibits type 2 diabetes, wherein the subject is suffering from type 2 diabetes, the method comprising the steps of:
    determining whether the subject has an Inhibin Subunit Beta E (INHBE) variant nucleic acid molecule encoding an INHBE predicted loss-of-function polypeptide by:
        obtaining or having obtained a biological sample from the subject; and
        performing or having performed a genotyping assay on the biological sample to determine if the subject has a genotype comprising the INHBE variant nucleic acid molecule; and
    when the subject is INHBE reference, then administering or continuing to administer to the subject the therapeutic agent that treats or inhibits type 2 diabetes in a standard dosage amount, and/or administering to the subject an INHBE inhibitor; and
    when the subject is heterozygous for an INHBE variant nucleic acid molecule, then administering or continuing to administer to the subject the therapeutic agent that treats or inhibits type 2 diabetes in an amount that is the same as or lower than a standard dosage amount, and/or administering to the subject an INHBE inhibitor;
    when the subject is homozygous for an INHBE variant nucleic acid molecule, then administering or continuing to administer to the subject the therapeutic agent that treats or inhibits type 2 diabetes in an amount that is the same as or lower than a standard dosage amount;
    wherein the presence of a genotype having the INHBE variant nucleic acid molecule encoding an INHBE predicted loss-of-function polypeptide indicates the subject has a decreased risk of developing type 2 diabetes.

2. The method according to claim 1, wherein the subject is INHBE reference, and the subject is administered or continued to be administered the therapeutic agent that treats or inhibits type 2 diabetes in a standard dosage amount, and/or is administered an INHBE inhibitor.

3. The method according to claim 1, wherein the subject is heterozygous for an INHBE variant nucleic acid molecule, and the subject is administered or continued to be administered the therapeutic agent that treats or inhibits type 2 diabetes in an amount that is the same as or lower than a standard dosage amount, and/or is administered an INHBE inhibitor.

4. The method according to claim 1, wherein the INHBE variant nucleic acid molecule is a missense variant, a splice-site variant, a stop-gain variant, a start-loss variant, a stop-loss variant, a frameshift variant, or an in-frame indel variant, or a variant that encodes a truncated INHBE polypeptide.

5. The method according to claim 1, wherein the INHBE inhibitor comprises an antisense nucleic acid molecule that hybridizes to an INHBE mRNA.

6. The method according to claim 1, wherein the INHBE inhibitor comprises an siRNA that hybridizes to an INHBE mRNA.

7. The method according to claim 1, wherein the INHBE inhibitor comprises an shRNA that hybridizes to an INHBE mRNA.

8. The method according to claim 1, wherein the therapeutic agent is chosen from metformin, insulin, glyburide, glipizide, glimepiride, repaglinide, nateglinide, thiazolidinediones, rosiglitazone, pioglitazone, sitagliptin, saxagliptin, linagliptin, exenatide, liraglutide, semaglutide, canagliflozin, dapagliflozin, and empagliflozin, or any combination thereof.

9. A method of treating a subject with a therapeutic agent that treats or inhibits liver inflammation, wherein the subject is suffering from liver inflammation, the method comprising the steps of:
    determining whether the subject has an Inhibin Subunit Beta E (INHBE) variant nucleic acid molecule encoding an INHBE predicted loss-of-function polypeptide by:
        obtaining or having obtained a biological sample from the subject; and
        performing or having performed a genotyping assay on the biological sample to determine if the subject has a genotype comprising the INHBE variant nucleic acid molecule; and
    when the subject is INHBE reference, then administering or continuing to administer to the subject the therapeutic agent that treats or inhibits liver inflammation in a standard dosage amount, and/or administering to the subject an INHBE inhibitor; and
    when the subject is heterozygous for an INHBE variant nucleic acid molecule, then administering or continuing to administer to the subject the therapeutic agent that treats or inhibits liver inflammation in an amount that is the same as or lower than a standard dosage amount, and/or administering to the subject an INHBE inhibitor;
    when the subject is homozygous for an INHBE variant nucleic acid molecule, then administering or continuing to administer to the subject the therapeutic agent that treats or inhibits liver inflammation in an amount that is the same as or lower than a standard dosage amount;
    wherein the presence of a genotype having the INHBE variant nucleic acid molecule encoding an INHBE predicted loss-of-function polypeptide indicates the subject has a decreased risk of developing liver inflammation.

10. The method according to claim 9, wherein the subject is INHBE reference, and the subject is administered or continued to be administered the therapeutic agent that treats or inhibits liver inflammation in a standard dosage amount, and/or is administered an INHBE inhibitor.

11. The method according to claim 9, wherein the subject is heterozygous for an INHBE variant nucleic acid molecule, and the subject is administered or continued to be administered the therapeutic agent that treats or inhibits liver inflammation in an amount that is the same as or lower than a standard dosage amount, and/or is administered an INHBE inhibitor.

12. The method according to claim 9, wherein the INHBE variant nucleic acid molecule is a missense variant, a splice-site variant, a stop-gain variant, a start-loss variant, a stop-loss variant, a frameshift variant, or an in-frame indel variant, or a variant that encodes a truncated INHBE polypeptide.

13. The method according to claim 9, wherein the INHBE inhibitor comprises an antisense nucleic acid molecule that hybridizes to an INHBE mRNA.

14. The method according to claim 9, wherein the INHBE inhibitor comprises an siRNA that hybridizes to an INHBE mRNA.

15. The method according to claim 9, wherein the INHBE inhibitor comprises an shRNA that hybridizes to an INHBE mRNA.

16. The method according to claim 9, wherein the therapeutic agent is a hepatitis therapeutic or a hepatitis vaccine.

* * * * *